United States Patent 8,344,211 (PLANT NUCLEOTIDE SEQUENCES AND CORRESPONDING POLYPEPTIDES) - sequence listing, part 9

SEQ ID NO: 33832 - protein, 105 aa, Zea mays
  misc_feature: Ceres CLONE 1411983-F
  misc_feature (20)..(20): Xaa is any aa, unknown, or other
  misc_feature (30)..(30): Xaa is any aa, unknown, or other
  misc_feature (64)..(64): Xaa is any aa, unknown, or other
  misc_feature (75)..(75): Xaa is any aa, unknown, or other
  misc_feature (94)..(94): Xaa is any aa, unknown, or other
  misc_feature (95)..(95): Xaa is any aa, unknown, or other
  misc_feature (98)..(98): Xaa is any aa, unknown, or other
MDVNDVLLVVLAAALAAMWXRRCSSTGGVXGLPPGPSGWPAVGNLPPGFRRRRPFWAGGAPPRXVRALLPLRRGXPSPSRGQVGGTSTSSQFIXXAPXEENRAEV

SEQ ID NO: 33833 - DNA, 716 bp, Zea mays
  misc_feature: Ceres CLONE 1411990-F
  misc_feature (386)..(386): n is a, c, t, g, unknown, or other
  misc_feature (470)..(470): n is a, c, t, g, unknown, or other
  misc_feature (512)..(512): n is a, c, t, g, unknown, or other
  misc_feature (578)..(578): n is a, c, t, g, unknown, or other
  misc_feature (586)..(586): n is a, c, t, g, unknown, or other
  misc_feature (589)..(589): n is a, c, t, g, unknown, or other
agagctggagctccccgcggtggcggccgctctagaactagtggatcccccgggctgcaggaattcgcacgagaccattacctagaacatcctaatcaaaactctctctctctctgatcgatcgtccttcctccacccgtctgccccctcctccgcgcgcgcctgttcatggccaggaagaggacggcggcgcgccatcagcaccaggaaccaccgccaaaccctaaccctaacctccgccgccgggccgcggccagcgacccggcctcggacgagccgccgccgtcgtcgaagcgcatgctggcctttcacttcctccgcgcgctggccaggatccacagcaccaccccggcgccgcgccgcccgcgcaccatccgccgcgcggnctactcgtccatggcgcgcgctgccagcccacgccgggcctggacgcaggcgctgctccgccaggctcgcgcccgcagggcggntgccaggtcctccaggggagccgccctgctgcggagacccgncgcctccgccgcgggggcctcttcctccgcccgtggtgcggggccgcggtcgggttgtccccgtcngggccctnctncctcggggggtctttgcgcctggggcctccccggggcccccccgccttggtccgtcctgtccctttccctcttccccccccgccccccgtgctcgctcctgctctttgccgcctgtcgcgtctcgtt

SEQ ID NO: 33834 - DNA, 682 bp, Zea mays
  misc_feature: Ceres CLONE 1411991-F
  misc_feature: Encodes the peptide sequence at SEQ ID NO. 33835
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
cgcggtggcggccgctctagaactagtggatcccccgggctgcaggaattcgcacgagaccattacctagaacatcctaatcaaaaagaacacatcttgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctccgccgccgccgcggatcccttccctgaagccttctcctccccgaccaaggcttctcaagatgccgctgaggccggagaggacaacctgagctcgatgtgggaggaagctggcgacgccgacgacatctttgcctcccccggcagcgccgacgccgtagccgaccgatgaggaggtcgcccgcatctgcgcccgccgtggagtccaccccccgaggacgagatcgcctccaccctcgctgacatgaccgtggacttcaacgagccctcccctagccgcagtccctccttgctgctgatcaatggctcctgtaaagaagctggatttccctggttcactaatgccgcgaagaataaccccgcttccagagctccnnnnaaaatcttggaggttctcgtgagca

SEQ ID NO: 33835 - protein, 109 aa, Zea mays
  misc_feature: Ceres CLONE 1411991-F
MMWRSRARALLLLRSTITRPPPPPPQPYPTRTLTRVPPPRFLSSSPDPIPDSSSAAAADPFPEAFSSPTKASQDAAEAGEDNLSSMWEEAGDADDIFASPGSADAVADR

SEQ ID NO: 33836 - DNA, 672 bp, Zea mays
  misc_feature: Ceres CLONE 1411996-F
  misc_feature: Encodes the peptide sequence at SEQ ID NO. 33837
  misc_feature (88)..(88): n is a, c, t, g, unknown, or other
  misc_feature (352)..(352): n is a, c, t, g, unknown, or other
  misc_feature (377)..(377): n is a, c, t, g, unknown, or other
aagctggagctccccgcggtggcggccgctctacaatagtggatcccccgggctgcaggaattcgcacgagaccattacctagaacantcctaatcgaaaagaggatatgtttccctcaccttcgaccaccactaacctctgcatccgcatctctctctctcgcgcgcgccgcccttcccagcgccgtcggctgccgctcctcccctccaccgccgcctctgctccgcccgtcctcgcgccgtcgcgaccgctgcggcttcgtctctccccattgtctgtcccctctcaacgcactctacgacggaccgatgacttgacggatctgggggtttgtctagggtgggtgaacgnaaggggatggagttcacggagtcgntcaagcagacgggcccgtgctccttctcccccgactcggggttccttggtaatgccggaaactaccgcctcctcgtccgcgagggattctccttgaagggggtacaaataatttccaggggggggaaagaaaaaacccttgaaaaaggggcccccaaatcccgaaaataatttattggggggcattaacaaggggcccatggggcgcagctctgggcacttgggcccccctcgagtgggcccgggcaaaattgaaaaagggccacccagggaatatggaatgggctccggggggg

SEQ ID NO: 33837 - protein, 62 aa, Zea mays
  misc_feature: Ceres CLONE 1411996-F
  misc_feature (7)..(7): Xaa is any aa, unknown, or other
MEFTESXKQTGPCSFSPDSGFLGNAGNYRLLVREGFSLKGVQIISRGGKEKTLEKGAPKSRK

SEQ ID NO: 33838 - DNA, 666 bp, Zea mays
  misc_feature: Ceres CLONE 1411997-F
  misc_feature: Encodes the peptide sequence at SEQ ID NO. 33839
aaagctggagctccccgcggtggcggccgctctagaactagtggatcccccgggctgcaggaattcgcacgagaccattacctagaacatcctaaaaaaaatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggggaagtcttcgcccgcgtcggccgcggccggctcaaggaggacgccgcgagaaggacttccaccagttcgtccgggcccgcct

SEQ ID NO: 33839 - protein, 122 aa, Zea mays
  misc_feature: Ceres CLONE 1411997-F
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVGMIDQIKREISVMRLVRHPNVVQLHEVMASKSKIYFAMEYVRGGEVFARVGRGRLKEDAARRTSTSSSGPA

SEQ ID NO: 33840 - DNA, 731 bp, Zea mays
  misc_feature: Ceres CLONE 1412002-F
  misc_feature: Encodes the peptide sequence at SEQ ID NO. 33841
  misc_feature (389)..(389): n is a, c, t, g, unknown, or other
  misc_feature (395)..(395): n is a, c, t, g, unknown, or other
  misc_feature (461)..(461): n is a, c, t, g, unknown, or other
  misc_feature (499)..(499): n is a, c, t, g, unknown, or other
aaagctggagctccccgcggtggcggccgctctatcactagtggatcccccgggctgcaggaattcgcacgagaccattacctagaacatcctaatcgaaaacccccaaagggcaaaggcccaaacccagccggtcagtcccccaccccccagcagccatggagttcggcttccgcgcaggaaaccgcacgcagcgccgcccttcccccgatcgacgcgtcacagcacagcaagccggacccttccacggcgaccacccgcagccctcgccgttgcagtgggaggatgcggcccggcgcgagcggatcaaacgcgaggtggagcgccggctcatcgaggaggaggtccgcctggagctcgcccttgagcgcgcccgcctccacggtggntttggncccgccccgttcctcgggaccgacggctccgtcgtgccggtgcagccaccacctccacctccaggncggttctccagggccgacggcccatcgatgacgccggnaatgtcgtgggacgacaggcctcggcggctcgcgagatttgagcaaccgatgttccttcaggcagacgggaacggggtcccttggttgcgaagccgagggaatcccttctgttggggaagatttccgccaagcgtaaacttccgagtttctttctccaacaccacggtgttttgtgccgtgtaaggaaaccgggagggtgtttttcccgcggtaagcttagccccccttaat

SEQ ID NO: 33841 - protein, 174 aa, Zea mays
  misc_feature: Ceres CLONE 1412002-F
  misc_feature (114)..(114): Xaa is any aa, unknown, or other
MEFGFRAGNRTQRRPSPDRRVTAQQAGPFHGDHPQPSPLQWEDAARRERIKREVERRLIEEEVRLELALERARLHGGFGPAPFLGTDGSVVPVQPPPPPPGRFSRADGPSMTPXMSWDDRPRRLARFEQPMFLQADGNGVPWLRSRGNPFCWGRFPPSVNFRVSFSNTTVFCAV

SEQ ID NO: 33842 - DNA, 684 bp, Zea mays
  misc_feature: Ceres CLONE 1412003-F
  misc_feature: Encodes the peptide sequence at SEQ ID NO. 33843
cgcggtggcggccgctctagaactagtggatcccccgggctgcaggaattcgcacgagaccattacctagaacatcctaatcgaaaagtccccaacccacgcactgcccaccggtctctctcacacaacacagggatataagcccagtccacgagatctcccgtagaccagtggcgagggaagggaaggaacgaaacagagcccgatcctagcgacagggcagggaagatcgccatgatgatgatgggcgaaggcgtgagcgtgccgccgtggtcccaccacgtccccgtgagcggcgtcgacgtcggcgtcggcggagacgagatgacgccgtacctactggcggcgctgcggcagtacctgccgtgcaacgacgccggcgccgccgaggcggacgacgaggaggcggcggccatggccgcgggcgtggacggctacggctgcgacgagttccgcatgtacgagttcaaggtccggcggtgcgcccgcgcgcgcagccacgactggaccgagtgccccttcgcgcacccggggggagaaggcgcgacggcgcgaccccgcgcaggtacttttactcgggtggccgcctgcccggatttccggaaaggctgggatgaaggtgaaccgtatgccctgaggactccggggagggcactaattaattgcttgcgcgccaccatcccg

SEQ ID NO: 33843 - protein, 150 aa, Zea mays
  misc_feature: Ceres CLONE 1412003-F
MMMMGEGVSVPPWSHHVPVSGVDVGVGGDEMTPYLLAALRQYLPCNDAGAAEADDEEAAAMAAGVDGYGCDEFRMYEFKVRRCARARSHDWTECPFAHPGGEGATARPRAGTFTRVAACPDFRKGWDEGEPYALRTPGRALINCLRATIP

SEQ ID NO: 33844 - DNA, 725 bp, Zea mays
  misc_feature: Ceres CLONE 1412007-F
aaagctggagctccccgcggtggcggccgctctagaactagtggatcccccgggctgcaggaattcgcacgagaccattacctagaacatcctaatcgaaaagacgacacacctgacacgtgggtctatcagtcatcctggtccttttattttctttcttctctcacccggttcttcctcctcccgagtcccgaactctcgatccactcatccgctgagggcgtcggccttctggcccttctccccccggccgacctcgcccctccggcgctccgtccgcttcctgaactcgtctcccctcacggacgttctcctccctccgctcgccgcgccgcaacccggagaggagaccgccgctcggtcgagcaccacctggggcccagcgtcctcgcgaccagctctagcgcggcgtccgccctctgcagccctggtgtccccgcgactggcttcggccggcacacaactccacagttaggtctccgtctgcacagcgcggcgatcttctctctccttcccgccctctgcagtccctctcagtccctctccgtctgcttgattctgctccaacctcagactaccctcgctctgaaaatgtcattacgcacccaatgcgcttgtagctgtatgctgcaaccctactctgcctcgtcttcttccatcaccctaagcatgcgcgcaacccccactcaccaacgacgggcccggccgccgccgccgtcctggct

SEQ ID NO: 33845 - DNA, 752 bp, Zea mays
  misc_feature: Ceres CLONE 1412010-F
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (752)..(752): n is a, c, t, g, unknown, or other
tccccnnnnnnnnnnnnccncctccccctccactctgccggtccccctccgccgaggcggctttcggggggcggccgctctagaatagtggatcccccgggctgcaggaattcgcacgagaccattacctagaacatcctaatcgaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgccgctcgcgaatcgggggttcacacatagcttcgtcgttttgaatttgatgtactattgaagtctaagggtggcaagaagtctagcagtagccgttccatgatgtatgaagctccccttggtacagcaattgaggacgttcgacctccgagggcgcgaaaaaaggtccagtctgctgcttaactccactgcgcaaagaacccatctgaaaatccctttgggctcctccgttcaaagaaggttaagattttcttttctgacctttcgaatccttaccaatcccccctgggccgggtggttttcctgagaaaccgaccaggttccccggtttggggtccctgggggccatcccccctcatattgccgggagggtgggggttagtgaactcactgggn

SEQ ID NO: 33846 - DNA, 705 bp, Zea mays
  misc_feature: Ceres CLONE 1412011-F
  misc_feature: Encodes the peptide sequence at SEQ ID NO. 33847
  misc_feature (651)..(651): n is a, c, t, g, unknown, or other
ggagctccccgcggtggcggccgctctagaactagtggatcccccgggctgcaggaattcgcacgagaccattacctagaacatcctaatcgaaaagtccccaacccacgcactgcccaccggtctctctcacacaacacagggatataagcccagtccacgagatctcccgtagaccagtggcgagggaagggaaggaacgaaacagagcccgatcctagcgacagggcagggaagatcgccatgatgatgatgggcgaaggcgtgagcgtgccgccgtggtcccaccacgtccccgtgagcggcgtcgacgtcggggtcggcggagacaagatgacgccgtacctactggccgggctgccccagtacctgccgtgcaacgacgccgggcgccgccgaggcggacgaaaaggaggcggcggccatggccgcgggcgtgaacggataccggttggaaccagttcccgaatggacgaatttcagggtccggggggaggggcccgcgcggccaagccacgacggggcccaaggggccctttcgggcaccccggggggaaaaaggcgcggtgggtcgcaaatcggagaaggataccactaattgcggcgggcggtatggcccggaatttacccaaaggagcggggcgaacaacncacgctccatcttatccacaaacctgcgcccgctctcttttcggtaaggcctgc

SEQ ID NO: 33847 - protein, 154 aa, Zea mays
  misc_feature: Ceres CLONE 1412011-F
MMMMGEGVSVPPWSHHVPVSGVDVGVGGDKMTPYLLAGLPQYLPCNDAGRRRGGRKGGGGHGRGRERIPVGTSSRMDEFQGPGGGARAAKPRRGPRGPFGHPGGKKARWVANRRRIPLIAAGGMARNLPKGAGRTTHAPSYPQTCARSLFGKAC

SEQ ID NO: 33848 - DNA, 588 bp, Zea mays
  misc_feature: Ceres CLONE 1412014-F
  misc_feature (324)..(324): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaacaccattgaaacactctctgaccctcactcgctccctgtcacacacactacactcgcaattcatccgcagtcacaagctcggctgctgctcccgctaacggttgaggcgttgctggtgcacacaggaagggaagggaagggagagctgcacacagctttgctctggctcttggctcccctgtccagctgtcctgtccgtccatcatgggagaaacgcccagncccgcaactctagccggccggcaaatcccggccccgaaaacgggggccaaaaagaaaaaaaaaaaaggggggggttgttttttttttttaacccccccccccccaaaaaaagagggggggggggggggntcccccccccccccccccggggggggaaccccccccccccccccccccgggggggggggggggttcttcccccccccccacaaaaaaaaaccctctcctcccccccccccaaaaaaaaaaccccttcttttttag

SEQ ID NO: 33849 - DNA, 602 bp, Zea mays
  misc_feature: Ceres CLONE 1412016-F
  misc_feature: Encodes the peptide sequence at SEQ ID NO. 33850
  misc_feature (93)..(93): n is a, c, t, g, unknown, or other
  misc_feature (208)..(208): n is a, c, t, g, unknown, or other
  misc_feature (333)..(333): n is a, c, t, g, unknown, or other
aaactggagctccccgcggtggcggccgctctagaactagtggatcccccgggctgcaggaattcgcacgagaccattacctagaacatcctnaatcgaaaaggtcgggactccggactcgggagtcggcactcgggtctcgacgtctcgtctcgtctcgtctcgcctgcccgcagccccttggctttgttccatccggcttctcggncggcggcggagaagagggggatggcgcaccggctgctgcgggacgcgcaggcggacgggtgggagcggtcggacttcccatcatctgcgagtcatgccctcgcgacaaccctacgtccggatggntagagctgaatatgacaaagatgcaaaattgggcacgtccctttactggattccgggggcgtcctgggcgaaattgcaggtaccaaaaaaactgaatctggcacaaaaatgtgtgaaattaaaaaaatgtctggcccagccccggcccggggggaatttgaaaaaggggccgcccggtcaagggcccaaaaaaaaaaactccccttttaatttccagggggggaaattcccggggggggggggggccctccccaaaattttttggcaaa

SEQ ID NO: 33850 - protein, 141 aa, Zea mays
  misc_feature: Ceres CLONE 1412016-F
  misc_feature (31)..(31): Xaa is any aa, unknown, or other
  misc_feature (69)..(69): Xaa is any aa, unknown, or other
  misc_feature (111)..(111): Xaa is any aa, unknown, or other
TGAPRGGGRSRTSGSPGLQEFARDHYLEHPXSKRSGLRTRESALGSRRLVSSRLACPQPLGFVPSGFSXGGGEEGDGAPAAAGRAGGRVGAVGLPIICESCPRDNPTSGWXELNMTKMQNWARPFTGFRGRPGRNCRYQKN

SEQ ID NO: 33851 - DNA, 716 bp, Zea mays
  misc_feature: Ceres CLONE 1412018-F
  misc_feature: Encodes the peptide sequence at SEQ ID NO. 33852
  misc_feature (506)..(506): n is a, c, t, g, unknown, or other
  misc_feature (513)..(513): n is a, c, t, g, unknown, or other
  misc_feature (575)..(575): n is a, c, t, g, unknown, or other
gctctagaactagtggatcccccgggctgcaggaattcgcacgagaccattacctagaacatcctaatcgaaaacccgttagttgcccagccccagacccagagaggagggcgacgaacacacggtgacggagagccgagtggacaggacaggagcgcggagggaggaggaaacaaagcagaaaaagcaacccccgtcttccatcttcgcggaacgacgcccatctggcctgcccatctctttcgtgctcctaccccccgccttcttccgccctcaaggcttttccttccttctcatcttctgctcggaccggggacgggccgacggggacagggacaaaaggtggtgcgatcttgttcggcacagagagagagagagagcgacggagggtggcagggccgccgcgccggtgagccgacccccagccatggcattgccggctccccccgtcccgctggcgctgctgctgctcgtcgcgctggcattctgcgccgcgcatccggggncgggggncttcatgctcctcgccacttccagacgcccgcgctccactctgatggatttggcttggtggncagaaggtcgattgctgaagctcctgctgacatcaacgtcactacgaatagctcctttggtgctggcggagataggacatatcgaagggaccctttgatggctccaggaaatacccggccggctgaaaaacagggaagtga

SEQ ID NO: 33852 - protein, 81 aa, Zea mays
  misc_feature: Ceres CLONE 1412018-F
  misc_feature (27)..(27): Xaa is any aa, unknown, or other
  misc_feature (29)..(29): Xaa is any aa, unknown, or other
  misc_feature (50)..(50): Xaa is any aa, unknown, or other
MALPAPPVPLALLLLVALAFCAAHPGXGXFMLLATSRRPRSTLMDLAWWXEGRLLKLLLTSTSLRIAPLVLAEIGHIEGTL

SEQ ID NO: 33853 - DNA, 702 bp, Zea mays
  misc_feature: Ceres CLONE 1412022-F
  misc_feature: Encodes the peptide sequence at SEQ ID NO. 33854
  misc_feature (527)..(527): n is a, c, t, g, unknown, or other
aaagctggagctccccgcggtggcggccgctctagaactagtggatcccccgggctgcaggaattcgcacgagaccattacctagaacatcctaatcaaaaaaaacgaaagatcctcctccctcccaaaggtgaggccgttagccaggaattccggcaacaatgacttccctctcctccgctgtggcactgccgtcctcgtgccgggcccggccggcggggggcagccggagggcgcggatggtggtgacgcgcgcggcggcgtcgagcccgaagctgccgaacgggcggcggctgcgggtggcggtggtgggaggcggccccgccggtggcgccgcggcggaggcgctggccaagggcggcgtggagacggtgctaatcgagcggaagatggacaactgcaagccctgcggcggcgccatccctctgtgcatggtgtcggagttcgacctgccgctcgaccttgtggaccgcaaggtgaggaagatgaagatgatttcgccgtccaacgtcgccgtcgacatcggncgcacgctcgcgccccacgagtacatcgggatggtcaggcgcgaggtgctcgacgcctacctccgctcacgggcacagtccggcgggcgcggaggccgtcaacggccctcttcctaaggcacgaggccccccacgagcctaatggctcttacgagccgcactaaaaacccttcaa

SEQ ID NO: 33854 - protein, 160 aa, Zea mays
  misc_feature: Ceres CLONE 1412022-F
MTSLSSAVALPSSCRARPAGGSRRARMVVTRAAASSPKLPNGRRLRVAVVGGGPAGGAAAEALAKGGVETVLIERKMDNCKPCGGAIPLCMVSEFDLPLDLVDRKVRKMKMISPSNVAVDIGRTLAPHEYIGMVRREVLDAYLRSRAQSGGRGGRQRPSS

SEQ ID NO: 33855 - DNA, 729 bp, Zea mays
  misc_feature: Ceres CLONE 1412028-F
  misc_feature: Encodes the peptide sequence at SEQ ID NO. 33856
  misc_feature (340)..(340): n is a, c, t, g, unknown, or other
  misc_feature (385)..(385): n is a, c, t, g, unknown, or other
  misc_feature (420)..(420): n is a, c, t, g, unknown, or other
aagctggagctccccgcggtggcggccgctctagaactagtggatcccccgggctgcaggaattcgcacgagaccattacctagaactcctaatcgaaaaaaatccaagtaaggaaatccccgatgatctcctgcgcgtcgcagcgccagccactcgattagtggagtccaccaaccaagcacgcgtccctccccgtcccagatcccatcccgcggcagccggtcagtccgatccatctccagtacccagcccgtcacccgccttccccgttcgctctcgtcggcgcgcgatggagggtctcatcaaggggttggtccacgtggccatcgacgccgtggnaggacgccgtgagggagagggaccacggccgcgccgacgacgacnaaggtgccgaggaggagggcggcccaaagctccgnatccagatgacgacgggggaggaggaacgcgacgaacgatcgcggtcgacgtgggccgaggtcgtctccgagcagaagggcagcgatccggacgagcgccgggaccatcgaagctcggggcgggacaatcgccatgagaggagggatgacgagggttggaaaaggggcgatggtcggaacagcagcagcaccacgcaggcggagaaaccagtgctagggggaggaaaagggggggatggcagtggcaacccggcggcgtcagcaacagcagcaggcacaaggatacgggaatcagcatcagggaagaga

SEQ ID NO: 33856 - protein, 101 aa, Zea mays
  misc_feature: Ceres CLONE 1412028-F
MTTGEEERDERSRSTWAEVVSEQKGSDPDERRDHRSSGRDNRHERRDDEGWKRGDGRNSSSTTQAEKPVLGGGKGGDGSGNPAASATAAGTRIRESASGKR

SEQ ID NO: 33857 - DNA, 717 bp, Zea mays
  misc_feature: Ceres CLONE 1412032-F
  misc_feature: Encodes the peptide sequence at SEQ ID NO. 33858
  misc_feature (502)..(502): n is a, c, t, g, unknown, or other
  misc_feature (717)..(717): n is a, c, t, g, unknown, or other
aaagctggagctccccgcggtggcggccgctctagtactagtggatcccccgggctgcaggaattcgcacgagaccattacctagaacatcctaatcgaaaaaaccaccgcacctagctcgggcatccatccactctcgtccccgtcccgtacttacctgactgagctcacacacacacgtacgatgccgaagccgtggaggccggtgctggcgtcggccaccaagtgctgcgcggcggaggacgcggcggtggcgccggacggcctggcgcggtgccggccgcagcagtcggagctgtcgcggcggctggcgtccttcaggcgcctctcgtcgctggccaacagcccggtgtccgccaccgccaccacggtggcggacaaggacggcggtagcgtgaagcaggccgcctgcggggagatggcgggcccgctgcagctgcactcgttcgggctgggcgagctccgcggcatcacgcacgacttctccagcaacttcctgctncgggagggcggcttcggcgccgtgtacaagggcttcgtggacgccaggatgcgcccggcctcgacgccagccccgtcgcgtgaagagctcaacgccgcggggttccagggccaccggaagtggctcgccgagttctcttaatggcgcaggtcccgcacccgcacttggcaagctgttgggctactgctggcaagacaggaacccctgttcctctn

SEQ ID NO: 33858 - protein, 152 aa, Zea mays
  misc_feature: Ceres CLONE 1412032-F
  misc_feature: SWISSPROT Homolog: EC 2.7.11.1 Non-specific serine/threonine protein kinase
MPKPWRPVLASATKCCAAEDAAVAPDGLARCRPQQSELSRRLASFRRLSSLANSPVSATATTVADKDGGSVKQAACGEMAGPLQLHSFGLGELRGITHDFSSNFLLREGGFGAVYKGFVDARMRPASTPAPSREELNAAGFQGHRKWLAEFS

SEQ ID NO: 33859 - DNA, 596 bp, Zea mays
  misc_feature: Ceres CLONE 1412033-F
  misc_feature (298)..(298): n is a, c, t, g, unknown, or other
  misc_feature (314)..(314): n is a, c, t, g, unknown, or other
  misc_feature (317)..(317): n is a, c, t, g, unknown, or other
  misc_feature (318)..(318): n is a, c, t, g, unknown, or other
  misc_feature (322)..(322): n is a, c, t, g, unknown, or other
  misc_feature (539)..(539): n is a, c, t, g, unknown, or other
  misc_feature (541)..(541): n is a, c, t, g, unknown, or other
  misc_feature (542)..(542): n is a, c, t, g, unknown, or other
  misc_feature (545)..(545): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (551)..(551): n is a, c, t, g, unknown, or other
  misc_feature (552)..(552): n is a, c, t, g, unknown, or other
  misc_feature (555)..(555): n is a, c, t, g, unknown, or other
  misc_feature (557)..(557): n is a, c, t, g, unknown, or other
  misc_feature (559)..(559): n is a, c, t, g, unknown, or other
  misc_feature (574)..(574): n is a, c, t, g, unknown, or other
  misc_feature (575)..(575): n is a, c, t, g, unknown, or other
  misc_feature (578)..(578): n is a, c, t, g, unknown, or other
agagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatggtggtggcgtcggntgctcaaagaaccggnggnngtcnaaggcttcccgcggggccttccggttggccggggggggaacctggttcaggggatccggggagagggcccttagggaggggggggccccccccgggaaaaaaggggcccctttttccccaggggggggggggggagggcccccccctttggggggggcccccccgccgggggggtttctcccccccccggccgggggtgttgttttaaaaaaaaagncnnccngnnncnnttntntncgggggggggggggnncgnggcgccgggaggcgcact

SEQ ID NO: 33860 - DNA, 731 bp, Zea mays
  misc_feature: Ceres CLONE 1412035-F
  misc_feature: Encodes the peptide sequence at SEQ ID NO. 33861
  misc_feature (491)..(491): n is a, c, t, g, unknown, or other
  misc_feature (522)..(522): n is a, c, t, g, unknown, or other
  misc_feature (529)..(529): n is a, c, t, g, unknown, or other
  misc_feature (531)..(531): n is a, c, t, g, unknown, or other
  misc_feature (589)..(589): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaacttcttcttttttccctacccctccgccgttgctctgcaaggcacgcgtcctgcacgcgccaaagctaggcgataaactggaaaggagcgcgcagcgcaggcttcgggctcctgtctccgccgcggcgtcctctcgctttttcaggactttcaggacttgcaggctctgcgcagcgcgatctgacatctgaccgggtcagacgatacagcccatatactacgttacgtcgagtcctcaaagttcaattctacctggaccattgcacccatcttggcccaaagtacttgcgcgccgcgctacgaacgaggccatccgccgccacacgccgtcggccatgccgcagaagtcagaaagcggcactgctggggagggcgacgaggagcagcgnctgcgggctgctctgcgtcaccctgcagcgnaggcggngntgctggaacgcctggtgtacaagcaccggaaccagcaccgcgggcgcggctatttccnnatactccctcaaggtggaggaggaacttgagcttttgctccggccccgccccccgtgaggccctcaagggcggtttcccagttttccaatggccgaaggcggcaaaacgattcccggcccaaaaagcaatctaaaaaaaaa

SEQ ID NO: 33861 - protein, 60 aa, Zea mays
  misc_feature: Ceres CLONE 1412035-F
  misc_feature (29)..(29): Xaa is any aa, unknown, or other
  misc_feature (31)..(31): Xaa is any aa, unknown, or other
  misc_feature (32)..(32): Xaa is any aa, unknown, or other
  misc_feature (51)..(51): Xaa is any aa, unknown, or other
MPQKSESGTAGEGDEEQRLRAALRHPAAXAXXLERLVYKHRNQHRGRGYFXILPQGGGGT

SEQ ID NO: 33862 - DNA, 723 bp, Zea mays
  misc_feature: Ceres CLONE 1412036-F
  misc_feature (308)..(308): n is a, c, t, g, unknown, or other
aaagctggagctccccgcggtggcggccgctctagaactagtggatcccccgggctgcaggaattcgcacgagaccattacctagaacatcctaatcgaaaaaagtccagacccgcagcgcccgccggaggcggagggaaccgagccggcgaccggcagaccgcagagaagaggcctggagccgaccgcagagaagaggccaggagccgaccgcaggcagccgccaccgcaccagaacccgaggtctcgaggcaatcgagcgcacgcgggtcgggggctgcggccatgtcggtgagttgcgggctcgnagtgggtggtgtgccttggctgcacgcggtgggcgtggaagcggctcacctacatcggcgcctacgacagcgagacgtggccgccggcgtccgccgacgagttcgagcccgtcccgcgcctctgccgcgccgtgctcgcgaactacgacgaggagctctccagccccaagttcgcgccgccggagcacggctacttcgatatcgaccccaagggcatcctcaagcgggctaactacgacgaggtccgcaacgcgtgcccgccgtacctcgtctacgtcgacgaggcgcacaaggagatcatcctcgccgtgcgcggcctcaacctcgtgcggcacgccgactaacaggggctcatggacaacaggctcgggatgcaaatggttcacgggggctacctgcaccccggcctgctcat

SEQ ID NO: 33863 - DNA, 709 bp, Zea mays
  misc_feature: Ceres CLONE 1412044-F
  misc_feature (709)..(709): n is a, c, t, g, unknown, or other
aaagctggagctccccgcggtggcggccgctctagaactagtggatcccccgggctgcaggaattcgcacgagaccattacctagaacatcctaatcaaaaagacgtccacagtgcgccgtgttctgccgcgcctgcgctcccaccgcgtgtccgcaactctgccccacctcacatccgcgtccgcaatccgcgcctccgccgccgcagcccttcctccgcgcagcgtccgtccatccatggctctccctacacgcagtgtcgtgccgctttccgcaatccgtgcctcaatccccttccttcgcgcagtgcccttccatccatggctcgcttccagaaatcccctacctacggcgcagcgtcgcagtcaggaatccgcccccaaaatcactacccgctctgcggcgatggaagggaatcaatccgtcaatggaaggaacacgtgcttcccccttccatcctcggcgctgcgcggattgcggattgcatggccatcgtttcgcgccccaatccgtcgatgcaaggaacgcgtgcttcccccttccatcctcggcgctgcgcgaattgcagattgcatggtcatcgtttcgccccagttcattgcccgcatcagatggaagggtgccccgatccgcctcactccatcaatgaggtgcctgcctttcttgcatggagacgccaaagagaaggaccaatcactaagtcggccn

SEQ ID NO: 33864 - DNA, 709 bp, Zea mays
  misc_feature: Ceres CLONE 1412045-F
  misc_feature: Translation starting site: 170
  misc_feature (629)..(629): n is a, c, t, g, unknown, or other
agagctggagctccccgcggtggcggccgctctagaactagtggatcccccgggctgcaggaattcgcacgagaccattacctagaacatctaatcgaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctgggtcgatggtgcccgccgaaaaggcggcggaagccggcggcgacaggccccgcagatcgaccgtcacgcagttcggctacttcaagtgctcggggaaagggggtgctgccgcccaagcccatcgtcgtcaaggccaagctcatctccaaggtcgccgagaagaagatcaaggccgccggcgggcgccgtcgtgctcacgaagcttggggaggcgagcaccccgnatccggcgaggtgccgcgagcgaggcagcgatgagaggccgtgcgtcccatctccgcgcgctcctctcgcgagcgctctc

SEQ ID NO: 33865 - DNA, 689 bp, Zea mays
  misc_feature: Ceres CLONE 1412055-F
  misc_feature: Translation starting site: 142
  misc_feature: SWISSPROT Homolog: EC 1.10.3.2 Laccase
  misc_feature (535)..(535): n is a, c, t, g, unknown, or other
  misc_feature (547)..(547): n is a, c, t, g, unknown, or other
  misc_feature (575)..(575): n is a, c, t, g, unknown, or other
  misc_feature (609)..(609): n is a, c, t, g, unknown, or other
  misc_feature (633)..(633): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaaaaaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacaatgtggtcgtcaatgtgctcaacagcttagacgagcccctgctcatcacttggggatgggatccagcagcgcaagaattgctgggcaggatggggttctcggcaccacctgccccataccgccaggttggaactggacctacaacttccaggtcaaggaccagattggcagcttcttctacttcccaccccttggtatgancgtgcccgcggnggggggttcggaggtatcactgtcaacnaccgcgcgggtcatctcggtcccattcgacacgncccgatggggacatcacgctcttncatcgggggactgggtacaagatgaaccacacgcaccntgaggaagatgctcgacg

SEQ ID NO: 33866 - DNA, 717 bp, Zea mays
  misc_feature: Ceres CLONE 1412056-F
  misc_feature: Encodes the peptide sequence at SEQ ID NO. 33867
  misc_feature (432)..(432): n is a, c, t, g, unknown, or other
  misc_feature (551)..(551): n is a, c, t, g, unknown, or other
  misc_feature (552)..(552): n is a, c, t, g, unknown, or other
  misc_feature (597)..(597): n is a, c, t, g, unknown, or other
  misc_feature (598)..(598): n is a, c, t, g, unknown, or other
  misc_feature (634)..(634): n is a, c, t, g, unknown, or other
  misc_feature (639)..(639): n is a, c, t, g, unknown, or other
  misc_feature (662)..(662): n is a, c, t, g, unknown, or other
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaaaagaagcagacgaacaccattctgggtggagccacttggaggcagcagcgaacaccattcttcgtgcaattattatctctctagataatagcacacttaactacagtacacatatatagcgaagagccttgacgtcgagggcagcaccgatcaagagctgcagtgcggagcagctcaatccagagctgtaatggcgacggtcctccttccgctgctgctcttgctcggctcggcggtgacgctcctaacgtgcgcgggcgcgggcgcgtcgttccccgtcaatgtctggccaaagccgacgtccatgtcatgggcggagccgcacgcggncgtacggggtgtcgccgtccttccacatcgtggcgtcatcgggtaacccgtacctcgcctcggacgcggagcgctacgccaagctgctgattcagggagacgtaccgactcatcgttcnncggcggcggtcaccgtcaccgcgttgaacgcgctggagacctgannccgggggggggtgtccgacctcgtcgtcccgatggnagtangggtgtaggacgagttctaacancgctggagattctnccccacgggcggcgcggcaggggggagcgggggcccaccgg

SEQ ID NO: 33867 - protein, 61 aa, Zea mays
  misc_feature: Ceres CLONE 1412056-F
  misc_feature (47)..(47): Xaa is any aa, unknown, or other
MATVLLPLLLLLGSAVTLLTCAGAGASFPVNVWPKPTSMSWAEPHAXVRGVAVLPHRGVIG

SEQ ID NO: 33868 - DNA, 602 bp, Zea mays
  misc_feature: Ceres CLONE 1412060-F
  misc_feature (228)..(228): n is a, c, t, g, unknown, or other
  misc_feature (229)..(229): n is a, c, t, g, unknown, or other
  misc_feature (237)..(237): n is a, c, t, g, unknown, or other
aaagctggagctccccgcggtggcggccgctctagaactagtggtcccccgggctgcaggattcgcacgagaccattacctagaacatcctaatcgaaaaagcacctccattcccagccacgagacgacgaaaccctagcctccctccccctctctcaccaggccaccaccctcgccggaaactccggcgccctcgaaggagcacggggatcattcggccgccccttnncccggggnttggggggggacggggaaaaaatgttaaaggggggcgggggggcccaaaaaaaggggaacacaaaaatgggggcctttgggggcgggggagaaaggggccccccgtttttctaaaaagggggggggggaacctctggggcgcccccgggggaaaaaaaaaaaacagggggggggggtttttttttggggggggtccggggggggtttaaaaaggggggggggaaaggggttttttccccctttttttttgggccccccccacaaaaaaaaggagaactttttttaaaaggggcgccccctttttttccccccccgcgggggggttttttttttatccggggggcccccaaaaagaagaaggaaaa

SEQ ID NO: 33869 - DNA, 717 bp, Zea mays
  misc_feature: Ceres CLONE 1412061-F
  misc_feature: Translation starting site: 542
aaagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctcccgccggccgcggctgcggctgctgctacggaggtgcccctcgccccgggcttccgcttccaccccaccgacgaggagctcgtctcctactacctccgccgccgcgtcctcggccgccggctccgcgtcgacgccatcgccgagatcgacctctaccgcctcgagccctgggacctcccctccctctcccgtatccggaggcgcgacgtccagtggtacttcttcgcccgtctcgaccgcaaggtcgccggcgctggcgccgggtgccggggcggacccggtaacaggaccaaccgcgctacgccgaggcggtactggaagacccgggcaaggagcgcgaggtgcaccaccgacgacagccggtcgggatggagaagacgctcggcttccacgcctggagggcgcctaagggggagaggaccattgggtcgtgcacgaacaccggcttctcgaagcagaggacccccaggaactggatgggggtgtgaccattcttccaaaaaccatgtttttgggaacatggaatggtggcgcacgaggcaca

SEQ ID NO: 33870 - DNA, 692 bp, Zea mays
  misc_feature: Ceres CLONE 1412063-F
  misc_feature (604)..(604): n is a, c, t, g, unknown, or other
  misc_feature (634)..(634): n is a, c, t, g, unknown, or other
  misc_feature (635)..(635): n is a, c, t, g, unknown, or other
tccccgcggtggcggccgctctagaactagtggatcccccgggctgcaggaattcgcacgagaccattacctagaacatcctaatcgaaaaggttatcacaataacccgactctcggacccacgacgagttaagcccggagggaaaaaggacaaatcacacaaaggcacagggaatcgcgccaccgtgggacgcgtacggcgcaccgcccgcccgccggatctgcgccggcgacgcgcccggacgtcggatctacgccgccgcaggaggggggaggcggcgctgttgccgttctctgcccgcgagcgcccggatccgtcccgccggtgacttcatctccgctaatccaacggataggcaaaactctaatctttgtcaaccatcaagtatatatatatatatcaatcaaaatggtcctgtgatatcgagcttcagttgatgcagaggtggtgaaaacatcttctcttctccaaagactgctgactgcaagttgcaaaagtttgtcttcagcttgctgtgttctttcttccctctctggcggagtacacgagaagtttgtagatataggcactaggcagctcctttcagctcttctatgtccaggnatttggactgtcctgttcagacacagaggnnctgtggcagtcctggaccggagcttcagcagtgaatatcctggaggagcagaaactg

SEQ ID NO: 33871 - DNA, 732 bp, Zea mays
  misc_feature: Ceres CLONE 1412064-F
  misc_feature: Encodes the peptide sequence at SEQ ID NO. 33872
  misc_feature (589)..(589): n is a, c, t, g, unknown, or other
  misc_feature (603)..(603): n is a, c, t, g, unknown, or other
aagctggagctccccgcggtggcggccgctctagaactagtggatcccccgggctgcaggaattcgcacgagaccattacctagaacatcctaatcgaaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgcggataagcaggggcggaagagggcgtgtgtcacgtactgcatcacctacatcctcagctgcatcaccaagcactctccccagtacaaatttcttaatgattgggcgtgggtccttggtggcattgccacttcgctgctcttctcagcngtttgagtcgtggnctcgtggcagagcacaacaagaaaggatttgatccaacaatggttgtcgataacattctccaaggctatatttcttggcaaatggtctagtggccccattgttgctgggctatttgcaaattctgtgtt

SEQ ID NO: 33872 - protein, 146 aa, Zea mays
  misc_feature: Ceres CLONE 1412064-F
  misc_feature (4)..(147): Pfam Name: DUF791 Pfam Description: Protein of unknown function (DUF791)
MEVFYYLVFGALAAIVAALELAKSGKDRVATSPAFNSFKNNYILVYSLMMSGDWLQGPYVYYLYSQYGFDKGDIGRLFIAGFGSSMLFGTIVGSLADKQGRKRACVTYCITYILSCITKHSPQYKFLNDWAWVLGGIATSLLFSAV

SEQ ID NO: 33873 - DNA, 705 bp, Zea mays
  misc_feature: Ceres CLONE 1412065-F
  misc_feature: Encodes the peptide sequence at SEQ ID NO. 33874
  misc_feature (387)..(387): n is a, c, t, g, unknown, or other
  misc_feature (676)..(676): n is a, c, t, g, unknown, or other
aaagctggagcgccccgcggtggcggccgctctagaactagtggatcccccgggctgcaggaattcgcacgagaccattacctagaacatcctaatcgaaaaccccagttgatgcgcgtcggatttgcttgtccgctatgggacgctggttcaagcccctttctcacccgccacactccatcacttgtcgctactcaccagattgccccgcgcccatgctgctgtggccgcctagctcgtgatcctgttctcctacccacaagttgcgattcgatctctggcgcagccatcgaatccatcctttgtccttgactcatacttctgttgcaatttgcgtgctggttcctccggtggtgcatgtgcacgggccatgttcgacgaggtggntttggagaagttttgttacatggtaatccccgtccttgggcttgtcatggtcgattgggaaacagtaggattggttgctgagcatggctggaccggaaaagacttggttgtttggttcaggagagacctcaggatccaggacaacccggccttggcagcggcggcgaaagggggctctgtcctccctatcttcatatggtgcccctcagactacgggcagacttacccctggaagtggctccccggtggtggctcaagcagtctcttgtccaaccttgggaagtcatangaggctgctcgggtgcccactcgtgctga

SEQ ID NO: 33874 - protein, 111 aa, Zea mays
  misc_feature: Ceres CLONE 1412065-F
  misc_feature: SWISSPROT Homolog: EC 4.1.99.3 Deoxyribodipyrimidine photo-lyase
  misc_feature (6)..(6): Xaa is any aa, unknown, or other
  misc_feature (102)..(102): Xaa is any aa, unknown, or other
MFDEVXLEKFCYMVIPVLGLVMVDWETVGLVAEHGWTGKDLVVWFRRDLRIQDNPALAAAAKGGSVLPIFIWCPSDYGQTYPWKWLPGGGSSSLLSNLGKSXEAARVPTRA

SEQ ID NO: 33875 - DNA, 654 bp, Zea mays
  misc_feature: Ceres CLONE 1412066-F
  misc_feature: Encodes the peptide sequence at SEQ ID NO. 33876
  misc_feature (339)..(339): n is a, c, t, g, unknown, or other
  misc_feature (348)..(348): n is a, c, t, g, unknown, or other
  misc_feature (390)..(390): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaaatatataatggtattacccccgtcgtcaaatgcaccgccacccaaccccatggccgccgccaccggaagaaccatgaagacgatggcgctcgtcgtcgtcctcgccgccctcctctgctccatctcggtcgccgctgcagccagcggcggcctttcttcgtacgtggtgtacctcggccagcacgcgcacggcgcggcgctgggcacgcacggcgccgaagagctgcaggcgctggnagcgcgacngccgccgaggcgcactgcgacctcctcggccggggtcttggnncggagaccagcaaaagggcgcgggaaggggatcttctactcgtacccgaaagcacatcaacgggtttccaggcaaacctgaacgccgccaccgcccgccgaaaattggggggaaaccccggggggggttttcgggggttcccaaaacagggggccgaaaggggccacaacccgggaaatgggaattttctcggcctgggcgggcccccgggggggtcccccccaggggggggggggggggggaaaagcacaaattcctggccg

SEQ ID NO: 33876 - protein, 98 aa, Zea mays
  misc_feature: Ceres CLONE 1412066-F
  misc_feature (55)..(55): Xaa is any aa, unknown, or other
  misc_feature (58)..(58): Xaa is any aa, unknown, or other
  misc_feature (72)..(72): Xaa is any aa, unknown, or other
MKTMALVVVLAALLCSISVAAAASGGLSSYVVYLGQHAHGAALGTHGAEELQALXARXPPRRTATSSAGVLXRRPAKGRGKGIFYSYPKAHQRVSRQT

SEQ ID NO: 33877 - DNA, 723 bp, Zea mays
  misc_feature: Ceres CLONE 1412073-F
  misc_feature: Encodes the peptide sequence at SEQ ID NO. 33878
  misc_feature (637)..(637): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcaaaaaactcgcacggacgagcgaggcagccccgcaggtcgcagccacaacccaagcgcagcgatctacctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaaaaaggcgaaggcgtaccgccctaggtggccccggctgccgggtggaccgcctcaacgcggagcggggaagggggtcttccctctcaaggacctcttcctcatctggctcgtcaccatcacctgcaccctgccgatccagtctctgttccccttcttgtatttcatgataagggatctgcatattgctaaacaaacacagacattggattttatggctggttttgttggcgcttcaaatatgtgtggggagggcagtctcctcaacagtatgggggaatcgtggctganaagtatggaagggaaacagttatcgtactgacccttattgcatagttacttcaatactatgtttggactaagctcnaactattgga

SEQ ID NO: 33878 - protein, 123 aa, Zea mays
  misc_feature: Ceres CLONE 1412073-F
  misc_feature (114)..(114): Xaa is any aa, unknown, or other
MGGGNGETTQLGEPLLAKKAKAYRPRWPRLPGGPPQRGAGKGVFPLKDLFLIWLVTITCTLPIQSLFPFLYFMIRDLHIAKQTQTLDFMAGFVGASNMCGEGSLLNSMGESWLXSMEGKQLSY

SEQ ID NO: 33879 - DNA, 640 bp, Zea mays
  misc_feature: Ceres CLONE 1412074-F
  misc_feature: Encodes the peptide sequence at SEQ ID NO. 33880
aaagctggagctccccgcggtggcggccgctctagaactagtggatcccccgggctgcaggaattcgcacgagaccattacctagaacatcctaatcgaaaaagcctgtcttgcctccctattccccaattctcccgacgagtccacgaccccagtatagtatccatccctaccctcgaccgcctcaacgaccacctgccacccggccaggcggccaccacgaccacggtcctgcgcccggcggtccttcactccccatgcgttccagcttgcgtacggccagtgcggcggtgccactgccgttccctgcaggtgagcaggtcgtagcccagatctgtgcgatcgtgcaccgccgccggcttcatagttcgcacacaccactagcgatcgactgtcctcgtgcatctccattctccgccagctactcgcgacctctccacgtgaccatggtgagcactacgttcggaaatggcaggtcggcccaggaagggataacaaaaatctttgggggggggtgtgggcccccccccttttggagaaaaaaaaaaaaaaaaaaaccccccctggggggggggaccccctgtggagaaaaaaatcttttttttttttttaaaaaaccccccgggagggggaggggaag

SEQ ID NO: 33880 - protein, 127 aa, Zea mays
  misc_feature: Ceres CLONE 1412074-F
MRSSLRTASAAVPLPFPAGEQVVAQICAIVHRRRLHSSHTPLAIDCPRASPFSASYSRPLHVTMVSTTFGNGRSAQEGITKIFGGGCGPPPFWRKKKKKKPPLGGGTPCGEKNLFFFFKKPPGRGRG

SEQ ID NO: 33881 - DNA, 709 bp, Zea mays
  misc_feature: Ceres CLONE 1412075-F
  misc_feature: Encodes the peptide sequence at SEQ ID NO. 33882
acagctggagctccccgcggtggcggccgctctagaactagtggatcccccgggctgcaggaattcgcacgagaccattacctagaacatcctaatcgaaaaactcatacatttcgactctcaactcccaaggtcccttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgccgcaagggacaacaagaagacgcgcatcattccgcgccacgtgctcctcgccatccgcaacgacgatgagctcggcaagctgctggccggcgtcaccatcgcccacggcggcgtcctccccacatccacactgtgctcctccccaagaaggggggcgagaaggcggaaaaggagcccataaaggcggccagtccccccagaagcggagagggaactctctcctaaaggggggggcaccctcctttaaaccccttacccctacgcgacggggcggcaccccacccatggtaccg

SEQ ID NO: 33882 - protein, 140 aa, Zea mays
  misc_feature: Ceres CLONE 1412075-F
  misc_feature (29)..(102): Pfam Name: Histone Pfam Description: Core histone H2A/H2B/H3/H4
MDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDDELGKLLAGVTIAHGGVLPTSTLCSSPRRGARRRKRSP

SEQ ID NO: 33883 - DNA, 701 bp, Zea mays
  misc_feature: Ceres CLONE 1412076-F
  misc_feature: Encodes the peptide sequence at SEQ ID NO. 33884
  misc_feature (346)..(346): n is a, c, t, g, unknown, or other
  misc_feature (395)..(395): n is a, c, t, g, unknown, or other
  misc_feature (570)..(570): n is a, c, t, g, unknown, or other
  misc_feature (582)..(582): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcaaaatccagtgcccgtaccgcgccgtccctatcgtgccggatcgccacccgctcgctgcgcccccacctcccccccctcgccggttcgccacttcgccccacctccgcgcctcagatccatccccaatccggcaaccctagcgccgggttcctcctcctcgtctccgcccgccgccgcctccattgccagaggtgatcgagggggagagacagagcttgggtggtcggattagggagagagggaggggngaggatgtccagaaggtcggtgaacccgagccggcgggtggcggacggnggcttgccgtccttcggcggcccgttccaccctaagtcacgctcgcctcccgtgctcaccattgccctcgtcgtcctgggtgtcatttttctcattgcctacttcaacagcagcccaggtgtaactgttacgagcaaagagactgtgaccaggtctgaaggttcttgcacatcanaaagtatgcggncgcttccatatcttaagaaggcatatggcaatgccatgcaaaagcgtctccatgtaggccctgatagntgtacagtagtttctaccctgttgaaagaaggaaagttgaagcatggggag

SEQ ID NO: 33884 - protein, 117 aa, Zea mays
  misc_feature: Ceres CLONE 1412076-F
  misc_feature (74)..(74): Xaa is any aa, unknown, or other
  misc_feature (78)..(78): Xaa is any aa, unknown, or other
  misc_feature (100)..(100): Xaa is any aa, unknown, or other
MSRRSVNPSRRVADGGLPSFGGPFHPKSRSPPVLTIALVVLGVIFLIAYFNSSPGVTVTSKETVTRSEGSCTSXSMRXLPYLKKAYGNAMQKRLHVGPDXCTVVSTLLKEGKLKHGE

SEQ ID NO: 33885 - DNA, 691 bp, Zea mays
  misc_feature: Ceres CLONE 1412077-F
  misc_feature (388)..(388): n is a, c, t, g, unknown, or other
  misc_feature (403)..(403): n is a, c, t, g, unknown, or other
  misc_feature (433)..(433): n is a, c, t, g, unknown, or other
  misc_feature (481)..(481): n is a, c, t, g, unknown, or other
  misc_feature (520)..(520): n is a, c, t, g, unknown, or other
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtagcagtagaaggaaaagagtcagtccgcccgtgactacnagtgatttgttgggntggtgggggttttgttgaggtcacgatgantgggaggcgggctgttggtggatcagaagcgtggtgtttccctggcgntccacaacttcgtggatctcctgcagcagaacggcgacnagaacctgggcttcgggtctctgatgccgcagacgtcctctggcgccagtgcgtggatggggggaggncgatctcgtggacccgcctccggatagcttcccggacgccggggaggacgacagcgacgatgacgtcgaggacatcgaggagctggagcgccgcatgtggcgt

SEQ ID NO: 33886 - DNA, 670 bp, Zea mays
  misc_feature: Ceres CLONE 1412078-F
  misc_feature: Encodes the peptide sequence at SEQ ID NO. 33887
  misc_feature (383)..(383): n is a, c, t, g, unknown, or other
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttggttgccgttgttgttgaagacgcgtagctncgagggttcgtgatttctcgccgaatcggttcgggaactggtaagctatggatctctcgcggcccgcatcgtcagacctctcgctcgggctgcactctcatgcccacgcccacgctcgcgtgcatgcggcagccgcgccgctgcgcctggtcgacgacgcgaagccggaacgccccggggccggnaaggcccacccggaaaaggaacacacggaacagggggaaaaaaaaattttcccctcccggggaaatcccccttggtaaaaagccccccccccgcgccaaaaa

SEQ ID NO: 33887 - protein, 71 aa, Zea mays
  misc_feature: Ceres CLONE 1412078-F
MDLSRPASSDLSLGLHSHAHAHARVHAAAAPLRLVDDAKPERPGAGKAHPEKEHTEQGEKKIFPSRGNPPW

SEQ ID NO: 33888 - DNA, 724 bp, Zea mays
  misc_feature: Ceres CLONE 1412080-F
  misc_feature: Encodes the peptide sequence at SEQ ID NO. 33889
  misc_feature (656)..(656): n is a, c, t, g, unknown, or other
aagctggagctccccgcggtggcggccgctctagaactagtggatcccccgggctgcaggaattcgcacgagaccattacctagaacatcctaatcgaaaagtggagtgttttggaaggcgttgcgatgagacgctgcggcggtgggggcgaggagtgcatccctcggtgatgagcagaatcaccaccggatcttaatctcccttgcctcgtttgcggcgagtctgcgctgtcggtggaggtgcatcccctccccttcccccggcgcttccgtctgctggatggactcagtgcttgcaactcggcccttaacaggagaacgacggccatgccgatgcgtggtgccgagtttcaagtggtatgatgggttcttcctctccatgctcgccactagcgcatttagcgtttccattaattgcaagaggtatcggctgtgtgcccacccgctccacatgtggatagcggtggagtacgccactgtcttcatcttccggctcctaatgtttgatgataatggtctcgctgtcggaatgggatatagagtctcggatggcaacagagatatcgctcgtgattgtgccaagaatatgtgagcctctcagcgcatagtgcgacttcgctaccgcttgtctctgggggttaggcactgagattggnaaccattgtgaggttagcacatgcaagtaggctgcgtggcctagaggaagggacacaatgtgcggatc

SEQ ID NO: 33889 - protein, 103 aa, Zea mays
  misc_feature: Ceres CLONE 1412080-F
MDSVLATRPLTGERRPCRCVVPSFKWYDGFFLSMLATSAFSVSINCKRYRLCAHPLHMWIAVEYATVFIFRLLMFDDNGLAVGMGYRVSDGNRDIARDCAKNM

SEQ ID NO: 33890 - DNA, 728 bp, Zea mays
  misc_feature: Ceres CLONE 1412083-F
  misc_feature: Encodes the peptide sequence at SEQ ID NO. 33891
  misc_feature (574)..(574): n is a, c, t, g, unknown, or other
  misc_feature (580)..(580): n is a, c, t, g, unknown, or other
  misc_feature (581)..(581): n is a, c, t, g, unknown, or other
  misc_feature (614)..(614): n is a, c, t, g, unknown, or other
  misc_feature (623)..(623): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaaaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacaccttcccgggctcgcccgcgcagcgcttcgtgtcggaggacggcgtcatcaactcgcgcccgcgggtgctgggcggcggcagctgcatcaacgccggcttctacacgcgggccagcgacgactacngtgcgnngcgtcgggtgggacctgggcgccgccggggcgncgtaacggntggggtggaggaccgtgttggcgttccanccggagctgggggcccctgggcaggccgcgcctgcaaggcggcctggtcccaggcccggggtccgcgctgcacaac

SEQ ID NO: 33891 - protein, 193 aa, Zea mays
  misc_feature: Ceres CLONE 1412083-F
  misc_feature: SWISSPROT Homolog: EC 4.1.2.10 Mandelonitrile lyase
  misc_feature (143)..(143): Xaa is any aa, unknown, or other
  misc_feature (145)..(145): Xaa is any aa, unknown, or other
  misc_feature (156)..(156): Xaa is any aa, unknown, or other
  misc_feature (159)..(159): Xaa is any aa, unknown, or other
  misc_feature (169)..(169): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTFPGSPAQRFVSEDGVINSRPRVLGGGSCINAGFYTRASDDYXAXRRVGPGRRRGXVTXGVEDRVGVPXGAGGPWAGRACKAAWSQARGPRCT

SEQ ID NO: 33892 - DNA, 705 bp, Zea mays
  misc_feature: Ceres CLONE 1412086-F
  misc_feature: Encodes the peptide sequence at SEQ ID NO. 33893
  misc_feature (705)..(705): n is a, c, t, g, unknown, or other
aaagctggagctccccgcggtggcggccgctctagaactagtggatcccccgggctgcaggaattcgcacgagaccattacctaaaacatcctaatcgaaaaaattgtctcgattttgacatgcacgtagtaagctgggattcttcgtatagaccggattaaaaccctaggccctagccaccgcccaccgtcgcctcagcaaatcctcctcccgtttcaccatgccgccctgctgctcccccaccacctccgccgtcaccgctgcggcggcatctcccggcgcctcgcgcagcgggggcctcctgcgccgctcgcgcccagcccccgccgccgtgaattgtaaaaagattgattctctgaggtcaatcaatggagcaccaccttgcattccggtgtccaacaggtcgttattgactcctgtaaccttgccagttttccgggatccaaacatgaggaacgacacgaggctgcgcatcttctcaggcacagccaatccttccctttcccaggagatagcaagttacttggggctagaacttgggaagataaccataaagaggtttgctgatggtgaaatatatgttcagttgcaagaaagtgtacggggctgtgatgttttccttgtgcaaccgtcgtgtcctcccagcaatgaaaatctatggagcttctgatcatgattgatggctgtaggagagcatctgctan

SEQ ID NO: 33893 - protein, 149 aa, Zea mays
  misc_feature: Ceres CLONE 1412086-F
  misc_feature: SWISSPROT Homolog: EC 2.7.6.1 Ribose-phosphate diphosphokinase
MPPCCSPTTSAVTAAAASPGASRSGGLLRRSRPAPAAVNCKKIDSLRSINGAPPCIPVSNRSLLTPVTLPVFRDPNMRNDTRLRIFSGTANPSLSQEIASYLGLELGKITIKRFADGEIYVQLQESVRGCDVFLVQPSCPPSNENLWSF

SEQ ID NO: 33894 - DNA, 720 bp, Zea mays
  misc_feature: Ceres CLONE 1412087-F
  misc_feature: Encodes the peptide sequence at SEQ ID NO. 33895
  misc_feature (510)..(510): n is a, c, t, g, unknown, or other
  misc_feature (644)..(644): n is a, c, t, g, unknown, or other
  misc_feature (645)..(645): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (698)..(698): n is a, c, t, g, unknown, or other
  misc_feature (699)..(699): n is a, c, t, g, unknown, or other
  misc_feature (703)..(703): n is a, c, t, g, unknown, or other
aagctggagctccccgcggtggcggccgctctagaactagtggatcccccgggctgcaggaattcgcacgagaccattacctagaacatcctaatcgaaaagcacatccctccccatcccgtgccccgtctccatccccactcctccaacggccgcgtcgttctcgttcgcccgccggcatcccattcgctcgtctcctcccctccgccggtcgctgtcaccccgtgtcgtcacgcgcccccggccgccgccatcactatcatcgttccccctcctaaagccacccgtacgccagcctcaatggattttttcaccgcatctgcatcctctcgccatggcgccgccgcccgcgtcgcctgctgactcggtccctgatccaaggccgaccgccagcgcgcccgtgcccatcaccgtgccgagcccgcgtgaccacgcgcaccaccaccacctggtagatcgtcgggacacgccgcggggccgcgcgtgggaaccggagcggaaccggcgcgnagaggcgatggacggtgctgcagcggtaagctggtacccggtgaggggcggtacgtctttagagacgtgccggcacgtgtcggactacctccccgatctcccgacctactcaaatccattacaagataaccggnnatactctgnnntgtgaagcagtactttgtaaacccagatgacacgtctggcannaaangatggtgtttcacaagg

SEQ ID NO: 33895 - protein, 106 aa, Zea mays
  misc_feature: Ceres CLONE 1412087-F
  misc_feature (59)..(59): Xaa is any aa, unknown, or other
  misc_feature (104)..(104): Xaa is any aa, unknown, or other
MAPPPASPADSVPDPRPTASAPVPITVPSPRDHAHHHHLVDRRDTPRGRAWEPERNRRXEAMDGAAAVSWYPVRGGTSLETCRHVSDYLPDLPTYSNPLQDNRXYS

SEQ ID NO: 33896 - DNA, 718 bp, Zea mays
  misc_feature: Ceres CLONE 1412090-F
  misc_feature: Encodes the peptide sequence at SEQ ID NO. 33897
  misc_feature (376)..(376): n is a, c, t, g, unknown, or other
  misc_feature (478)..(478): n is a, c, t, g, unknown, or other
  misc_feature (586)..(586): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcntgttccgcgggccgtggctcgcccgcgcggacttcctgctgacgtgcgacccggcggccgtccagcactgcctggcgtccaaccacgggggctacgacaggngccgagacttttgcggagatgttcgacctcctgggcgacgggctgctgggttgcggatgcccggcgtcgtgggcgcgccagcggcacgtcgccgccaccgtcttcggnaccccgggcgttcccggtccttcgtcctgtgcaccatggcgcgcaagaacggggcggctgctcgtgccggttcctggactgcgccggccgggaatcaggaaaggggacgggnggccttcttttaatttcgag

SEQ ID NO: 33897 - protein, 184 aa, Zea mays
  misc_feature: Ceres CLONE 1412090-F
  misc_feature (74)..(74): Xaa is any aa, unknown, or other
  misc_feature (108)..(108): Xaa is any aa, unknown, or other
  misc_feature (144)..(144): Xaa is any aa, unknown, or other
  misc_feature (181)..(181): Xaa is any aa, unknown, or other
MGALRSLAISYPEFLVAGLCFVSLSALRHAMRERRQRAPLSWPVVGMLPFVLANLGRLYDAITDALHGSGCTLXFRGPWLARADFLLTCDPAAVQHCLASNHGGYDRXRDFCGDVRPPGRRAAGLRMPGVVGAPAARRRHRLRXPGRSRSFVLCTMARKNGAAARAGSWTAPAGNQERGRXAFF

SEQ ID NO: 33898 - DNA, 706 bp, Zea mays
  misc_feature: Ceres CLONE 1412093-F
  misc_feature: Translation starting site: 231
  misc_feature (573)..(573): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatgggggcagcaccctcatcgtggtcacctcggcggagctcatccacgaggcgctggtgaagcagggccccatgttcgcgagccgggccgaggacagccccacccgctcctcttcagcgtcggnaagtgcaccgttcactcggcgcctacggcccccctgtggcgtgctctgcgccgcacttcgtcgccgagatcgtgccccgcaccgcgtcaaggcttctctgggatccggaagtggccgtggacccgcacttgcg

SEQ ID NO: 33899 - DNA, 704 bp, Zea mays
  misc_feature: Ceres CLONE 1412094-F
  misc_feature: Encodes the peptide sequence at SEQ ID NO. 33900
  misc_feature (646)..(646): n is a, c, t, g, unknown, or other
tccccgcggtggcggccgctctagaactagtggatcccccgggctgcaggaattcgcacgagaccattacctagaacatcctaatcgaaaaaattgtaaactgtgatcttccaggctgcaccaactccatctccaggtggaatggagttagcttgcctgcacactcagtcacggtggcgtccctataaggcgtaggcctgacgtcacccacgccctcgcctcgcacggggcggcgcggcggccggcggagggaatggcgaggcgaagcagaggcagcggcagcgtcacggacgcggcgtcgaaggcggacgcggcggcgatgcggatggtgtcccgcaggggcgccgtgcggctggtgctcgtgtcggccaccgcctgggccatgctcgggctcgtcgcgctcgccttccacctccggccatgcagctcccgcgtcgcattcctctcagctctttgcaaaaaagacagtaaagttctctctgtgttggactcgatggggctctcatccaaaccactccaccgctgcccgatacctgttgcggatgatcaaaatgttgttgtcataccaaagaggactccaacacattttgtgaagaaagtggcatatataactgttgacaaacaggataaaatccctcaccgctgntttggaggacgcaaaacctggaaacaggaggaggagagctttaactgaactctaccag

SEQ ID NO: 33900 - protein, 146 aa, Zea mays
  misc_feature: Ceres CLONE 1412094-F
  misc_feature (131)..(131): Xaa is any aa, unknown, or other
MARRSRGSGSVTDAASKADAAAMRMVSRRGAVRLVLVSATAWAMLGLVALAFHLRPCSSRVAFLSALCKKDSKVLSVLDSMGLSSKPLHRCPIPVADDQNVVVIPKRTPTHFVKKVAYITVDKQDKIPHRXFGGRKTWKQEEESFN

SEQ ID NO: 33901 - DNA, 708 bp, Zea mays
  misc_feature: Ceres CLONE 1412095-F
  misc_feature: Translation starting site: 239
  misc_feature (324)..(324): n is a, c, t, g, unknown, or other
  misc_feature (325)..(325): n is a, c, t, g, unknown, or other
  misc_feature (397)..(397): n is a, c, t, g, unknown, or other
  misc_feature (446)..(446): n is a, c, t, g, unknown, or other
  misc_feature (465)..(465): n is a, c, t, g, unknown, or other
  misc_feature (466)..(466): n is a, c, t, g, unknown, or other
  misc_feature (496)..(496): n is a, c, t, g, unknown, or other
  misc_feature (500)..(500): n is a, c, t, g, unknown, or other
aagctggagctccccgcggtggcggccgctctagaactagtggatcccccgggctgcaggaattcgcacgagaccattacctagaacatcctaatcgaaaaagaaacatagaaggcgtgtacaccaagaagaagccggccaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgactcctgcggcgnnggcgccgctggactcaagcatgtggaaagtccggtcccttcgggcaaaagaatgagcttctgctgaagctgnagggcagcagcatcaacccagtggactggaaggtgcaaaaaagcatgcntgagcctttccctgctcgnnaaataccttttatcccagtgactgatgtgncagnagtcgtggttgatggtggtcaagaaatcatggttccaaggcggaaatcaagtggtggtaagctcactcatttacggaagggggtttggggaaaaagctggggcttaaaaaaattggaccccaaagggctccgtaggtatttgttgccaaaggggaaggtttcccttttcccgggaattgtcctccggggttaagaacttggggccaag

SEQ ID NO: 33902 - DNA, 710 bp, Zea mays
  misc_feature: Ceres CLONE 1412096-F
  misc_feature: Encodes the peptide sequence at SEQ ID NO. 33903
  misc_feature (440)..(440): n is a, c, t, g, unknown, or other
  misc_feature (558)..(558): n is a, c, t, g, unknown, or other
  misc_feature (626)..(626): n is a, c, t, g, unknown, or other
  misc_feature (629)..(629): n is a, c, t, g, unknown, or other
  misc_feature (631)..(631): n is a, c, t, g, unknown, or other
  misc_feature (646)..(646): n is a, c, t, g, unknown, or other
tccccgcggtggcggccgctctagaactagtggatcccccgggctgcaggaattcgcacgagaccattacctagaacatcctaaaaaaaaaggtaaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggngcatcctggcgatggacgagtcgaacgcgacgtgcgggaagcggctggcgtccatcgggctggagaacacggaggccaaccggcaggcgtaccgcacgctgctggtcacggcgccggncctggggcagtacatctccggcgcatccctcttcgaggagacgctgtaccagtcccgccgtcgacggncgncnagatcgtggacatcntgggcggagcaggccattcgtgcccggggaatcaagggtggaccaggggccttgttcccgctcc

SEQ ID NO: 33903 - protein, 147 aa, Zea mays
  misc_feature: Ceres CLONE 1412096-F
  misc_feature: SWISSPROT Homolog: EC 4.1.2.13 Fructose-bisphosphate aldolase
  misc_feature (58)..(58): Xaa is any aa, unknown, or other
  misc_feature (97)..(97): Xaa is any aa, unknown, or other
  misc_feature (120)..(120): Xaa is any aa, unknown, or other
  misc_feature (121)..(121): Xaa is any aa, unknown, or other
MASATVLKSSFLPKKSEWGATRQAAAPRPPTVSMVVRASAYADELVKTAKTIASPGRXILAMDESNATCGKRLASIGLENTEANRQAYRTLLVTAPXLGQYISGASLFEETLYQSRRRRXXRSWTSWAEQAIRARGIKGGPGALFPL

SEQ ID NO: 33904 - DNA, 726 bp, Zea mays
  misc_feature: Ceres CLONE 1412098-F
  misc_feature: Encodes the peptide sequence at SEQ ID NO. 33905
  misc_feature (508)..(508): n is a, c, t, g, unknown, or other
  misc_feature (509)..(509): n is a, c, t, g, unknown, or other
  misc_feature (574)..(574): n is a, c, t, g, unknown, or other
aagctggagctccccgcggtggcggccgctctagaactagtggatcccccgggctgcaggaattcgcacgagaccattacctagaacatcctaatcgaaaaaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcgccccgcgcgtccccgcccgcgtctaccaacggcgccgccaccgcgcttggaccccccgtgtccgcctcctttgcccgtgaccgcgccgaggacctgcaggacgaggcccgcgcgatggcacgcgccgctggcgccacagtctacagtcccgagatcctcgccgcccgatacggatcccgccccttcaaggtggcgctccggnncacggtaaggtgctgcccaactatggcgtcattcgattctgaatcgccaactggcagatcgaagnatggggagaaggcatcgcaagaagacgtcacacacgggcgccaggagactctcgcacgatcgtaccataggcattggggccagactttcgaagacaatgggacgagggccttgaccaagcgatccctgacgctctggtgcagggcgaggtaa

SEQ ID NO: 33905 - protein, 101 aa, Zea mays
  misc_feature: Ceres CLONE 1412098-F
  misc_feature (30)..(30): Xaa is any aa, unknown, or other
  misc_feature (52)..(52): Xaa is any aa, unknown, or other
MARAAGATVYSPEILAARYGSRPFKVALRXTVRCCPTMASFDSESPTGRSKXGEKASQEDVTHGRQETLARSYHRHWGQTFEDNGTRALTKRSLTLWCRAR

SEQ ID NO: 33906 - DNA, 657 bp, Zea mays
  misc_feature: Ceres CLONE 1412111-F
  misc_feature (547)..(547): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggctgtgtacggactggggatcggggatccctccggaccgggataggattttcgttttgctggcgaggaagggagcttcccccgatagatgtctcacctccgataccctggatttcgtccgtggcgagtggctaccgcttctgctccttttgtgacagctgaatctttgtggttcgaaggcgattgacttgggttcactgacgcggtgacgcccaatgagctcccacgtctccacatcgcggggtcttcatcccccaggcaagcttgggacgttggactcancccggtgcgtggcagccgccagcacctatggctcagcccgaagcaggccgcggtgatgaccnagaggtcaggcttgttgtcggttgcttggaatcaggactgtggatgct

SEQ ID NO: 33907 - DNA, 615 bp, Zea mays
  misc_feature: Ceres CLONE 1412114-F
  misc_feature: Encodes the peptide sequence at SEQ ID NO. 33908
aaagctggagctccccgcggtggcggccgctctagaactagtggatcccccgggctgcaggaattcgcacgagaccattacctagaacatcctaaaaaaaaccttaatcctatactttcatcgggcgcggcgtgccccctcgcctccaaggctccaacgcatcaatcaatagagcgagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgagacatcctctctcgtggtgctcggtcccgtggtggggacgctcgttggaagggccacataccttcaggttttgggcatctggctgctgtcgcaaagcatatccttgattgtcgctggaacctcggtgaccaccctgctcatgtatgccaacctgagagccacaagcttcccggcattcatggcgctggtcgccgttaccaacgtctccggcgctctagctgccctctcagctctcgccggcaccatactgatcgagagagaatgggtggtggtgatctcgagcgggc

SEQ ID NO: 33908 - protein, 99 aa, Zea mays
  misc_feature: Ceres CLONE 1412114-F
MGRETSSLVVLGPVVGTLVGRATYLQVLGIWLLSQSISLIVAGTSVTTLLMYANLRATSFPAFMALVAVTNVSGALAALSALAGTILIEREWVVVISSG

SEQ ID NO: 33909 - DNA, 638 bp, Zea mays
  misc_feature: Ceres CLONE 1412122-F
  misc_feature: Encodes the peptide sequence at SEQ ID NO. 33910
aaagctggagctccccgcggtggcggccgctctagaactagtggatcccccgggctgcaggaattcgcacgaaaccattacctagaacatcctaatcaaaatccaattctattttcgtgaaattaaatgacgtgcctagatgtttgggtgtgataaatcgagtctaaactctttgtcccttgcaggtgcagtttctactagcagcaatatcatggattctgaggtagtgcatgtggtagagtcgtcgtttgtagtgccgagcgagccgacaccgtcggaggggctctcgctctctccgctggacctcgttctgcccagcagaggccacaccccaacagtctacctgtacagccccagcgatgttgccgccgccgatggtttcttcgacgtggccaggctcaaggaggctatggccaagaccttggtggccttctaccccctcgctggccgcctcggcgtcaacaacgatggcagggtagagatcacctgcaccggcgagggcgcactctttgtggtcgctcatgctgacctcagtgttggtgacatcgaggacgacttcaggccgtcgccggagctgaggaggctgtttgttccatgcgttgagccagcatccatcatattggccatacaggtgactt

SEQ ID NO: 33910 - protein, 166 aa, Zea mays
  misc_feature: Ceres CLONE 1412122-F
  misc_feature: SWISSPROT Homolog: EC 2.3.1.144 Anthranilate N-benzoyltransferase
MFGCDKSSLNSLSLAGAVSTSSNIMDSEVVHVVESSFVVPSEPTPSEGLSLSPLDLVLPSRGHTPTVYLYSPSDVAAADGFFDVARLKEAMAKTLVAFYPLAGRLGVNNDGRVEITCTGEGALFVVAHADLSVGDIEDDFRPSPELRRLFVPCVEPASIILAIQVT

SEQ ID NO: 33911 - DNA, 619 bp, Zea mays
  misc_feature: Ceres CLONE 1412124-F
  misc_feature: Translation starting site: 250
  misc_feature (391)..(391): n is a, c, t, g, unknown, or other
  misc_feature (426)..(426): n is a, c, t, g, unknown, or other
  misc_feature (505)..(505): n is a, c, t, g, unknown, or other
aaagctggagctccccgcggtggcggccgctctagaactagtggatcccccgggctgcaggaattcgcacgagaccattacctagaacatcctaatcgaaaactcgtcagactttcagttcttccaatctcttgcaagcacaactgcacaagggaacaggaggaaaaaagagcgagaactcgcagctgacgcgcacacggcaagccccaatcggagccgcggaccggatcagaactaggtctcgaggcgatggcaagcggaggcgagggcgcagggagcggcgaatcccctcccgccgcctcagtggaggcggcagcggtcgaggcgacgctgcacatccggtgcgcgaacggctccaagttcacggtgcagacggacctgggcgccacgntgggcgcgttcaaggagtcttatccggtagctgcnggcgtgcagcaccgcagcagcgcctgatctacaaaggccgcatcctcaaggacgagcaaaccctagacagctatggcgnttgagaaagatcccacaattccacttggtggcaggggtccccccacccagctggatccaaggggacctgttggtggcaacccccttacttccattactcccaagaaaggggccg

SEQ ID NO: 33912 - DNA, 663 bp, Zea mays
  misc_feature: Ceres CLONE 1412126-F
  misc_feature: Encodes the peptide sequence at SEQ ID NO. 33913
  misc_feature (320)..(320): n is a, c, t, g, unknown, or other
  misc_feature (324)..(324): n is a, c, t, g, unknown, or other
  misc_feature (374)..(374): n is a, c, t, g, unknown, or other
  misc_feature (411)..(411): n is a, c, t, g, unknown, or other
  misc_feature (416)..(416): n is a, c, t, g, unknown, or other
  misc_feature (418)..(418): n is a, c, t, g, unknown, or other
  misc_feature (425)..(425): n is a, c, t, g, unknown, or other
  misc_feature (428)..(428): n is a, c, t, g, unknown, or other
  misc_feature (456)..(456): n is a, c, t, g, unknown, or other
  misc_feature (482)..(482): n is a, c, t, g, unknown, or other
aaagctggagctccccgcggtggcggccgctctagaactagtggatcccccgggctgcaggaattcgcacgagaccattacctagaacatcctaatcaaaaaacaacgcacatgcggaagcggagacgctgacgcacctctgagcctggcggcgatttttctatataaccagcgccgctaattccgggtgcttcgctgtagagatgcggtaaaagcgaaagaagaatccgatccgcttctccacgccgaacccggtaaggccgccgccgcttctcgaatggcctcaacctcctcctccctcgctcagccgccggccgggngggnggcggcagcgtcgcccggggcagcttcctcgcccgaagatcgccgcgcangtggaaggccgcggcggccccgcccccggtcccgccntatgntncaagcgncgnggggtccctgggcggggtcatggaagcntgcttgctgaaacccaatccaattcntaaaaaccgggtggaattccaaccgacggggggcctacgggggattgggacatgggggccccccgggcccccccccaggggggggcgccgccttgggaaggggtttaaccctttttccacaaccttatagttaaaaaaacggggggggtttggaaaaaaccggggggtgaatttgggttaa

SEQ ID NO: 33913 - protein, 54 aa, Zea mays
  misc_feature: Ceres CLONE 1412126-F
  misc_feature (12)..(12): Xaa is any aa, unknown, or other
MEACLLKPNPIXKNRVEFQPTGGLRGIGTWGPPGPPPRGGRRLGKGFNPFSTTL

SEQ ID NO: 33914 - DNA, 637 bp, Zea mays
  misc_feature: Ceres CLONE 1412136-F
  misc_feature: Encodes the peptide sequence at SEQ ID NO. 33915
caaagctggagctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagacggagccttgaggtcaggatttctggtttgcctggtctgtctaaatctgttggatctgtgagtgacctgcgcgacagacctgtagtagttgatcaaagcaggtgggttggtcttcctcctgaattgcttcgagatgtaatgagaaggcttga

SEQ ID NO: 33915 - protein, 69 aa, Zea mays
  misc_feature: Ceres CLONE 1412136-F
MSFRSIVRDVRESFGSLSRRSLEVRISGLPGLSKSVGSVSDLRDRPVVVDQSRWVGLPPELLRDVMRRL

SEQ ID NO: 33916 - DNA, 680 bp, Zea mays
  misc_feature: Ceres CLONE 1412141-F
  misc_feature: Encodes the peptide sequence at SEQ ID NO. 33917
  misc_feature (313)..(313): n is a, c, t, g, unknown, or other
  misc_feature (314)..(314): n is a, c, t, g, unknown, or other
  misc_feature (395)..(395): n is a, c, t, g, unknown, or other
  misc_feature (416)..(416): n is a, c, t, g, unknown, or other
aaagctggagctccccgcggtggcggccgctctagaactagtggatcccccgggctgcaggaattcgcacgagaccattacctagaacatcctaatcgaaaaaccacaaagcggtgaaggagaaccaaggtaatcgaacccggaagcgaccttcttgagcccgaagcaaaaggcactgctcatcgatccgccactacgccacaaaatcctctcctactccggcagttctgctcgccgccgcctccacgatgacggaagacgtgcagatgaacgactcggagccccagcctgcggcctcagctcccgccgtcgnngcgcccgcgctctccacactacaccatctgaaggagatcgcgtccgtgatcgaggccggttctctgtccaaggagggtcgncgaatctcccggggcttccgnctcaccgtcggggtccgttgccgcctcccggggggagttccctttccctttgggtaccggtcccaaaaaaaagaacccttcttcggggaaaaaaaataaaaagaaaggggggggggccccaaaaaaaaaaaaaaaacccccccaaaaaaaaaacccgccgcccgtttttttcttaaaaaaaaagaaggaggagagggggggggtgggccgccaaaaaacaacaaaaagggggggggggcgcgcgtctccttttttgttgacaca

SEQ ID NO: 33917 - protein, 88 aa, Zea mays
  misc_feature: Ceres CLONE 1412141-F
  misc_feature (22)..(22): Xaa is any aa, unknown, or other
MTEDVQMNDSEPQPAASAPAVXAPALSTLHHLKEIASVIEAGSLSKEGRRISRGFRLTVGVRCRLPGGVPFPFGYRSQKKEPFFGEKK

SEQ ID NO: 33918 - DNA, 757 bp, Zea mays
  misc_feature: Ceres CLONE 1412146-F
  misc_feature (13)..(13): n is a, c, t, g, unknown, or other
  misc_feature (38)..(38): n is a, c, t, g, unknown, or other
  misc_feature (348)..(348): n is a, c, t, g, unknown, or other
  misc_feature (418)..(418): n is a, c, t, g, unknown, or other
  misc_feature (423)..(423): n is a, c, t, g, unknown, or other
  misc_feature (425)..(425): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (438)..(438): n is a, c, t, g, unknown, or other
  misc_feature (440)..(440): n is a, c, t, g, unknown, or other
  misc_feature (441)..(441): n is a, c, t, g, unknown, or other
  misc_feature (452)..(452): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (490)..(490): n is a, c, t, g, unknown, or other
  misc_feature (491)..(491): n is a, c, t, g, unknown, or other
  misc_feature (502)..(502): n is a, c, t, g, unknown, or other
  misc_feature (512)..(512): n is a, c, t, g, unknown, or other
  misc_feature (517)..(517): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (530)..(530): n is a, c, t, g, unknown, or other
  misc_feature (531)..(531): n is a, c, t, g, unknown, or other
  misc_feature (533)..(533): n is a, c, t, g, unknown, or other
  misc_feature (537)..(537): n is a, c, t, g, unknown, or other
  misc_feature (538)..(538): n is a, c, t, g, unknown, or other
  misc_feature (540)..(540): n is a, c, t, g, unknown, or other
  misc_feature (545)..(545): n is a, c, t, g, unknown, or other
  misc_feature (551)..(551): n is a, c, t, g, unknown, or other
  misc_feature (552)..(552): n is a, c, t, g, unknown, or other
  misc_feature (567)..(567): n is a, c, t, g, unknown, or other
  misc_feature (568)..(568): n is a, c, t, g, unknown, or other
  misc_feature (573)..(573): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (590)..(590): n is a, c, t, g, unknown, or other
  misc_feature (591)..(591): n is a, c, t, g, unknown, or other
  misc_feature (605)..(605): n is a, c, t, g, unknown, or other
  misc_feature (612)..(612): n is a, c, t, g, unknown, or other
  misc_feature (613)..(613): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (625)..(625): n is a, c, t, g, unknown, or other
  misc_feature (630)..(630): n is a, c, t, g, unknown, or other
  misc_feature (644)..(644): n is a, c, t, g, unknown, or other
  misc_feature (646)..(646): n is a, c, t, g, unknown, or other
  misc_feature (649)..(649): n is a, c, t, g, unknown, or other
  misc_feature (658)..(658): n is a, c, t, g, unknown, or other
  misc_feature (659)..(659): n is a, c, t, g, unknown, or other
  misc_feature (665)..(665): n is a, c, t, g, unknown, or other
  misc_feature (667)..(667): n is a, c, t, g, unknown, or other
  misc_feature (668)..(668): n is a, c, t, g, unknown, or other
  misc_feature (677)..(677): n is a, c, t, g, unknown, or other
  misc_feature (691)..(691): n is a, c, t, g, unknown, or other
  misc_feature (692)..(692): n is a, c, t, g, unknown, or other
  misc_feature (709)..(709): n is a, c, t, g, unknown, or other
  misc_feature (713)..(713): n is a, c, t, g, unknown, or other
  misc_feature (755)..(755): n is a, c, t, g, unknown, or other
cgggggagggacntttaaacgctcggcggagggatgtnattaaccgcccccattttgaaacggtgatttaaaccccccccggccgcggaagatgagactccccgcggtggcggccgctctagaactagtggatcccccgggctgcgggaagtcgcacgagaccattacctaaaacatcctaatcgaaaagtagcggttacgtccctttcgctctactgctctctctctctgtctggaccttgccggtgtctccctcggcggacatcaacccgcttcctgtgctctctatgctccccttcctttcgtagactcggacttcgactccctgcatggaccgggggtaaatgnatcgggggatttcaaatcggtagggtttcttcgtggtttattcgccgcaagatgtaagggagggtcttantttanancnnnaannnnaanannttgtagaatanatnnncagatctttttgggtttgagaaaaaatggaagnncgttagtggangaaaccttgngggcnttnnnggcnnntnngnaaannanttttntgttannttcggatgctaggannggganttcgcgccccannnttnnatactggatagccncaccctnnacccgtnnnaanctaantagtaattctgcgncnaanagtgccggnnaaaagncnntgcgatggncgcacttggcgacnngagacactgatcggtancgcnctaacccgtccgcggcattgcggcggtcgatgcgttgctagncg

SEQ ID NO: 33919 - DNA, 641 bp, Zea mays
  misc_feature: Ceres CLONE 1412154-F
  misc_feature: Encodes the peptide sequence at SEQ ID NO. 33920
  misc_feature (369)..(369): n is a, c, t, g, unknown, or other
  misc_feature (408)..(408): n is a, c, t, g, unknown, or other
  misc_feature (413)..(413): n is a, c, t, g, unknown, or other
  misc_feature (481)..(481): n is a, c, t, g, unknown, or other
aagctggagctccccgcggtggcggccgctctagaactagtggatcccccgggctgcaggaattcgcacgagaccattacctagaacatcctaatcgaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggncgtcctggagtacctcgccgctgaggtcctggagctcgncggcnacgctgcccaggacaacagaagacgcgcatcgtcccgccgcacgtgctgctggcgatccgcaacgacnaggagctcgggaagctggctgaccggcgtggacatccgcccacggggggcgtggtggccaaaattaaacccgggtcctggtggcccaaaaaaaaggggggaaaaagggtcccagggggggggaaaaaaggaagcccaatcccccccaaaaaaaaggcccc

SEQ ID NO: 33920 - protein, 157 aa, Zea mays
  misc_feature: Ceres CLONE 1412154-F
  misc_feature (31)..(97): Pfam Name: Histone Pfam Description: Core histone H2A/H2B/H3/H4
  misc_feature (67)..(67): Xaa is any aa, unknown, or other
  misc_feature (80)..(80): Xaa is any aa, unknown, or other
  misc_feature (82)..(82): Xaa is any aa, unknown, or other
MDATGTGAGGKAKKGAAGRKAGGPRKKSVTRSVKAGLQFPVGRIGRYLKKGRYAQRVGSGAPVYLAXVLEYLAAEVLELXGXAAQDNRRRASSRRTCCWRSATTRSSGSWLTGVDIRPRGAWWPKLNPGPGGPKKRGEKGSQGGGKKEAQSPPKKRP

SEQ ID NO: 33921 - DNA, 737 bp, Zea mays
  misc_feature: Ceres CLONE 1412157-F
  misc_feature: Encodes the peptide sequence at SEQ ID NO. 33922
  misc_feature (75)..(75): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
  misc_feature (82)..(82): n is a, c, t, g, unknown, or other
  misc_feature (737)..(737): n is a, c, t, g, unknown, or other
aaacgcggggggcggggagggggcgtgtcctctcaaaaaccaaacgacggaaataatgggtgggggggccccccntntnnancaagctggggctccccgcggtggcggccgctctagaactagtggatcccccgggctgcaggaattcgcacgagaccattacctagaacatcctaatcgaaaaaagaagagccgccctacctattccttctccccgccgtcgagctgcccaacccagagcaccagcagccctcacctccttcctctcggccggtccttccaacgagcccgctggtcttggagccgccgccggtctcgttctggacgaacgttcaaggagattgcatttgtggatgctctaatggagtcgaaaggtggcaagaagtctagtagtagtaatagtaatttcatgtacgaagctccccttggctaccagatcgaggacgttcgcccagccggaggaatcaagaagttccagactgctgcttattccaactgcgtccgccagccatcctgatatcgcctcacctgccattcgcactagaggaagattttaattccggtttccttcttgcggcgggaagtctcccgtggggtctggtcgccatccttcggttcctgaaatcccactttggcttaaccgatcccgcccttttcctcgccgcaagcgggcgcctttcttggaaaacggtcattcccgggggcgcagtgcgtcccggagaacctcctggggcccn

SEQ ID NO: 33922 - protein, 51 aa, Zea mays
  misc_feature: Ceres CLONE 1412157-F
  misc_feature (1)..(51): Pfam Name: AdoMetDC_leader Pfam Description: S-adenosyl-l-methionine decarboxylase leader peptide
MESKGGKKSSSSNSNFMYEAPLGYQIEDVRPAGGIKKFQTAAYSNCVRQPS

SEQ ID NO: 33923 - DNA, 751 bp, Zea mays
  misc_feature: Ceres CLONE 1412158-F
  misc_feature: Encodes the peptide sequence at SEQ ID NO. 33924
  misc_feature (20)..(20): n is a, c, t, g, unknown, or other
  misc_feature (21)..(21): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (94)..(94): n is a, c, t, g, unknown, or other
  misc_feature (751)..(751): n is a, c, t, g, unknown, or other
tttttgggctgggcccgggnnttaagccccacgctcccgcgcgcgcggccgtgtagtggggtgtttgtgttgtcccccnnnnnnccaaactggngctccccgcggtggcggccgctctagaactagtggatcccccgggctgcaggaatgcgcacgagaccattacctagaacatcctaatcgaaaaaagaagagccgccctacctattccttctccccgccgtcgagctgcccaacccagagcaccagcagccctcacctccttcctctcggccggtccttccaacgagcccgctggtcttggagccgccgccggtctcgttctggacgaacgttcaaggagattgcatttgtggatgctctaatggagtcgaaaggtggcaagaagtctagtagtagtaatagtaatttcatgtacgaagctccccttgggtaccagatcgaggaccgtcgcccagccggaggaatcaagaaggtccagactgctgcttattccaactgcgtccgccagcccatcctgatatcgcctcccatgcaattcccaggagaagaaggattttaatttccgttttcccccttggggtcggaaggttctcccgttggcctcttggttggcatccctcctgtttcggaggatcccaacttgggcctaaccaatttcctcccttttccgtctttcatcccctctctttctttgcaaaacgggcaccccaatgggcgatgggctttcagacagaattctttgtgggcn

SEQ ID NO: 33924 - protein, 65 aa, Zea mays
  misc_feature: Ceres CLONE 1412158-F
  misc_feature (1)..(51): Pfam Name: AdoMetDC_leader Pfam Description: S-adenosyl-l-methionine decarboxylase leader peptide
MESKGGKKSSSSNSNFMYEAPLGYQIEDRRPAGGIKKVQTAAYSNCVRQPILISPPMQFPGEEGF

SEQ ID NO: 33925 - DNA, 650 bp, Zea mays
  misc_feature: Ceres CLONE 1412160-F
  misc_feature (457)..(457): n is a, c, t, g, unknown, or other
tggagctccccgcggtggcggccgctctagaactagtggatcccccgggctgcaggaattcgcacgagaccattacctagaacatcctaatcgaaaagccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcagttcgccgctgcagtttctagtttccagcggttcccaccagttgtctaataacttattgttgttgtacgtgaggttgcttttgtcgtatttgccaggttgcttttgttgtatttgccaggttgacancacttggtgttgtaaatcattggctatttttgggtcatgactttgtttttattgaaatcaattgggctgccaaggttcactaaatctttgatgcaacataataggatccaccatgctgtcttcttcagaacttggccagctttggttctagttctagcaaaccctgtcattggatcagcagaatttacttccc

SEQ ID NO: 33926 - DNA, 649 bp, Zea mays
  misc_feature: Ceres CLONE 1412164-F
  misc_feature: Encodes the peptide sequence at SEQ ID NO. 33927
  misc_feature (465)..(465): n is a, c, t, g, unknown, or other
  misc_feature (469)..(469): n is a, c, t, g, unknown, or other
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcaaaaattcccttctccatccacaactgtcctccacacacatccacacacgccacactgaggagccctgagccctccgcccttaaaccctagcgagcgagccagcgagaggtctcatccccaccaacaccacccatggagctccgcctctaccacctcgcgctgctgctcggcctcgtcgcctgggcggcggctgctgccacgggagccgaggcgcagccggtgtgcgacccctccatcatcgccacccagatcgcgctcttctgcatgccggacatgcccacggcgccctgctgcgagccgatcatcgcctccgtcgacctcggcggcggcgtcccctgcctctgccgcgtcgccgaccaaccggaantccnacctcccccgccttaacncaaacgacctactcctagctcctagaggcagtgggggaggcacgcgacacccggtggccctcgcgccgaccatccgcggccgcacggcggctacgaagagccggccccacaacctgggggggaagacggtgcgggggcccacgcccgccacgccgggagtag

SEQ ID NO: 33927 - protein, 84 aa, Zea mays
  misc_feature: Ceres CLONE 1412164-F
  misc_feature (79)..(79): Xaa is any aa, unknown, or other
  misc_feature (80)..(80): Xaa is any aa, unknown, or other
MELRLYHLALLLGLVAWAAAAATGAEAQPVCDPSIIATQIALFCMPDMPTAPCCEPIIASVDLGGGVPCLCRVADQPEXXPPPP

SEQ ID NO: 33928 - DNA, 633 bp, Zea mays
  misc_feature: Ceres CLONE 1412173-F
  misc_feature (328)..(328): n is a, c, t, g, unknown, or other
  misc_feature (336)..(336): n is a, c, t, g, unknown, or other
caaagctggagctccccgcggtggcggccgctctagaactagtggatcccccgggctgcaggaattcgcacgagaccattacctagaacatcctaatcgaaaaatcgatcactacggttccatctcgcacccaactaggcctccgattattccgatcgccagcggatcagatttatgcagtcttactgccgccagctccagccatgccgcgcggcagcagcttggaccagagcctgagcgacgaggagcggtcggcaggtactggggcggtttggatccggcgtcgccggcaatgtccgggatgccggactcgccggggccggcgggncgcgcggncgcaaagctgatgggtggagcagttccacctcaaggtgctccacgccgtcctcgccgtgcgcacgccgcgcccgctcgccaccgccgccgctgccgcgtcgtcgtcgtcgtcgttcaggcggagggacaggtgattccatctcccgctccacgacccgccgccgcccgaggcggccggtcgcctcgacgagctggcccccggggagccgcgtggtggtggacgtcctcctgtgtcctgcaccgccagtggtggtggagcccgagggagggggggggaaaagtggaccgtggcgtgcg

SEQ ID NO: 33929 - DNA, 594 bp, Zea mays
  misc_feature: Ceres CLONE 1412175-F
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgccggcggngaggagcaggtcggggaatgcgagatgtcggagatggccagggcgttccacatctcgccacgggtggcgacgt

SEQ ID NO: 33930 - DNA, 702 bp, Zea mays
  misc_feature: Ceres CLONE 1412206-F
  misc_feature: Encodes the peptide sequence at SEQ ID NO. 33931
  misc_feature (560)..(560): n is a, c, t, g, unknown, or other
  misc_feature (646)..(646): n is a, c, t, g, unknown, or other
tccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactagccgccatggcgtcgtcgtgcatcccggccggcggcatccggctgccggacctggagatggtcaaggccgcgccgccgccgccgccgccccgcccggcgcactcagcggcgtcctccacgctctcggaggcgtccaactcgtccccagcctcctcgtcgtcgttggcgtcgctgtcgctcaagcgcccgcgcacgccgcggaagcggcccagccagacgtacaacgaggcggcggcgctgctcgcgtccatgtacccctccgtattccccgtcgccaggggctgggggggccccgaggcggngcaccccggcttctcgggctcgctccgggttggcgaacgagccgtctgctcgaccctcctccctcggtccccgtcccggaggcacngcgctttctcctcggcgactggcggcgcgcgaaaagccccgcggcgtcgcaagagt

SEQ ID NO: 33931 - protein, 146 aa, Zea mays
  misc_feature: Ceres CLONE 1412206-F
  misc_feature (99)..(99): Xaa is any aa, unknown, or other
  misc_feature (128)..(128): Xaa is any aa, unknown, or other
MASSCIPAGGIRLPDLEMVKAAPPPPPPRPAHSAASSTLSEASNSSPASSSSLASLSLKRPRTPRKRPSQTYNEAAALLASMYPSVFPVARGWGGPEAXHPGFSGSLRVGERAVCSTLLPRSPSRRHXAFSSATGGARKAPRRRKS

SEQ ID NO: 33932 - DNA, 891 bp, Zea mays
  misc_feature: Ceres CLONE 1412208-F
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (30)..(30): n is a, c, t, g, unknown, or other
tggggttccccccccccccnnnnnatgccnccacaaatccccccccgtcctccccaaagctgggctccccgcggtggcggccgctctagaactagtggatcccccgggctgcaggaattcgcacgagaccattacctagaacatcctaatcgaaaaatcccatcccctcaggcctcagtcgtcagtccctcacacactcactatacactgctctgctgcagcaagaaggaagaagctagcgcctccctagctctcgttgtcagtaatggccaccaccgccgcgtccagcctcctcaagtcctccttcgcgggctcccggatcccttcggccacgcgcaccaccaccccgcccgtacgtggcaggagggcaccccgacgcgccggcgtgcggccccatcccgcgccgtccatcctccttcttcccccgcctccgaccctaaagaccttgacggtgccttccgggtatcaagcaccccatcacagggaacaccatccgtggtccccagcggaagatagaccccgggtcggcctaccatggacgggaaccttgaattccacccacgcgtccggaaccaccggaagggttggtgatattccgtggggtgcgactcggggaaccccgaagaccccctgggtccgcgaggggcagatacgtaggctggcccccaaaggaaacacccacacgcgcgaacgcgtcccggccattacccgcgaaagcgagtacgcagggttccacccggaaccagaacccctcacccaatgacctaggatcagatgaccaactatgtcccgcccgcgcccacggcaaggaggagcgcatatgacccgcagggcacaccgcggtctcgagggacacacaacactagcgggccaggcgaatacaaccaccag

SEQ ID NO: 33933 - DNA, 693 bp, Zea mays
  misc_feature: Ceres CLONE 1412209-F
  misc_feature: Encodes the peptide sequence at SEQ ID NO. 33934
  misc_feature (467)..(467): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgaccccgcgctacatgacggacatgatcacccacnccgacaccgacgtggtgatcgtgggcgccggggtccccggccctgtcctgcgcgtacgagctgccaaaggacccctccgggagcgtccccatcgtggaacaatcccgggtccccggcggggggnccgtgtttgggcggccaccttttctccgccatggggggggccaagcccggcccacttgtccctggaaaaattgggtggggataaaacagggccgggaatacg

SEQ ID NO: 33934 - protein, 160 aa, Zea mays
  misc_feature: Ceres CLONE 1412209-F
  misc_feature (86)..(86): Xaa is any aa, unknown, or other
  misc_feature (127)..(127): Xaa is any aa, unknown, or other
MATTAASSLLKSSFAGSRLPSATRTTTPSSVAVATPRAGGGPIRASISSSPTPPYDLTSFRFSPIKESIVSREMTPRYMTDMITHXDTDVVIVGAGVPGPVLRVRAAKGPLRERPHRGTIPGPRRGXRVWAATFSPPWGGPSPAHLSLEKLGGDKTGPGI

SEQ ID NO: 33935 - DNA, 702 bp, Zea mays
  misc_feature: Ceres CLONE 1412212-F
  misc_feature: Encodes the peptide sequence at SEQ ID NO. 33936
  misc_feature (402)..(402): n is a, c, t, g, unknown, or other
  misc_feature (442)..(442): n is a, c, t, g, unknown, or other
  misc_feature (445)..(445): n is a, c, t, g, unknown, or other
  misc_feature (455)..(455): n is a, c, t, g, unknown, or other
ggagctccccgcggtggcggccgctctagaactagtggatcccccgggctgcaggaattcgcacgagaccattacctagaacatcctaatcgaaaaattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctggtcttccctgatctatctagataatggcgaccacgacgtcagcgaccaccgccgcagcagcagccgccaccaccgcccagncgcgggggtcgtcgtcggccctctgccagagggtggccgncgncggcaggcgncgctcccgggttgtggggggcgacgccgccgggtggaaggccaggcgccagccgggggaaagggggccaggggcccccccctcaaaagagtcaggaatccgcccgcccggtcctgggagcaaagggggccccttgctggggtggggcctgaggggcccccccgcacccgtggaagaggccgagaaaactttgtggtgcaaagagaaatgtggcccccgggtttttaagaaactccctagccggacca

SEQ ID NO: 33936 - protein, 119 aa, Zea mays
  misc_feature: Ceres CLONE 1412212-F
  misc_feature (20)..(20): Xaa is any aa, unknown, or other
  misc_feature (33)..(33): Xaa is any aa, unknown, or other
  misc_feature (34)..(34): Xaa is any aa, unknown, or other
MATTTSATTAAAAAATTAQXRGSSSALCQRVAXXGRRRSRVVGGDAAGWKARRQPGERGPGAPPSKESGIRPPGPGSKGGPLLGWGLRGPPAPVEEAEKTLWCKEKCGPRVFKKLPSRT

SEQ ID NO: 33937 - DNA, 680 bp, Zea mays
  misc_feature: Ceres CLONE 1412213-F
  misc_feature: Encodes the peptide sequence at SEQ ID NO. 33938
  misc_feature (288)..(288): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaatgaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggnagcgaacagaaggccagggacgcagtgctctaccactacaagaacgccgccagcggcttctccgcgaagctcaccccccagcaggtcaagggatctcaggagcaaccaggtgttctccaggttgtgccgagccagacttaccagctacatgggtctgggtctggcactcaccagggcacgacacacaccttgggccttatgtgaaggcgtatgagaatcaagaagattgtgtttagtatggctgtatggcacaggtctgacgaatgtgtatagtacagtactatgtaagaataagggacgtatcgtctatatactgcttttgcgcttggtcagccctgttctaaagcttgtaatgcaccatggcgatggtttcaatacaatgacaaggatgn

SEQ ID NO: 33938 - protein, 129 aa, Zea mays
  misc_feature: Ceres CLONE 1412213-F
  misc_feature (35)..(112): Pfam Name: Subtilisin_N Pfam Description: Subtilisin N-terminal Region
  misc_feature: SWISSPROT Homolog: EC 3.4.21.25 Cucumisin
MKKTSSPLLIVLFLTAAAMAAEPEKQAAPAAQETAVHIVYVDRPEDADPEEFHIRTLTPVLGSEQKARDAVLYHYKNAASGFSAKLTPQQVKGSQEQPGVLQVVPSQTYQLHGSGSGTHQGTTHTLGLM

SEQ ID NO: 33939 - DNA, 722 bp, Zea mays
  misc_feature: Ceres CLONE 1412215-F
  misc_feature: Encodes the peptide sequence at SEQ ID NO. 33940
  misc_feature (424)..(424): n is a, c, t, g, unknown, or other
  misc_feature (428)..(428): n is a, c, t, g, unknown, or other
  misc_feature (429)..(429): n is a, c, t, g, unknown, or other
aaagctggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatggcaacctggaagtcaaacaaaacaagcgcaagtcaagggggctcaaaaaggaaaagtgcagggactcagcaccacttttacctggncttnnctgatgatctgctatggctggcctaaacgagttcctcgacttggacagcccaaactcaggatggtttgcaaaaatggagaccgttttttggcctgggaattaacttttacctccttgggaaaaaaaaattggagggcaaaaaaaatgggggtttttctttaaaagggggccgggaagggaaaaaaaccgggggacgctttttgtcccccctcccacggttgggggggccccccccccccttcccccaaagagtttaaaaaaaatgggtttttggggggggcccctccgagggc

SEQ ID NO: 33940 - protein, 90 aa, Zea mays
  misc_feature: Ceres CLONE 1412215-F
  misc_feature (81)..(81): Xaa is any aa, unknown, or other
  misc_feature (82)..(82): Xaa is any aa, unknown, or other
  misc_feature (83)..(83): Xaa is any aa, unknown, or other
MDAASRPPPPHGAGVRVRAPLVESVSCYCRLDTGLKTVVEARKFVPGAKMCMATWKSNKTSASQGGSKRKSAGTQHHFYLXXXDDLLWLA

SEQ ID NO: 33941 - DNA, 626 bp, Zea mays
  misc_feature: Ceres CLONE 1412219-F
  misc_feature: Encodes the peptide sequence at SEQ ID NO. 33942
  misc_feature (280)..(280): n is a, c, t, g, unknown, or other
  misc_feature (289)..(289): n is a, c, t, g, unknown, or other
  misc_feature (292)..(292): n is a, c, t, g, unknown, or other
  misc_feature (293)..(293): n is a, c, t, g, unknown, or other
  misc_feature (298)..(298): n is a, c, t, g, unknown, or other
  misc_feature (306)..(306): n is a, c, t, g, unknown, or other
  misc_feature (356)..(356): n is a, c, t, g, unknown, or other
  misc_feature (357)..(357): n is a, c, t, g, unknown, or other
ggagctccccgcggtggcggccgctctagaatagtggatcccccgggctgcaggaattcgcacgagaccattacctagaacatcctaatcgaaaagtcacccacgagcccaacaaaccactcccacccggtggctcgtcctcggacgccaagccactccgcgccccaatccggaagcgccgccgccgccgatcgaccggccgtcgacccatgctccgctcggcgctcttcagctcagcccccgggctccgccggtctccgacgacggcccactttatcanccgcgccgncgnncgcgnagtgtggntctccaacggccctgcctccgccccgtctagggtgcgcctcctcatcggnngggaagttcgtcgagtcccgcgccgaacgaggacgtcgaacttcaccaccccggggaacgaggaggtggggtcccggatcccggtcaccacgggcgatgaattcaaagttgccggcaaagccccccggaacggcttccccgggttggggaaaacccccgtaaaaaaggggaagggggttttgttaaaattcaagaactttttccgggttaaaatggggcaaatttgggaaaaaactcctctccggggggggggaaagcccttaaaaatg

SEQ ID NO: 33942 - protein, 139 aa, Zea mays
  misc_feature: Ceres CLONE 1412219-F
  misc_feature (24)..(24): Xaa is any aa, unknown, or other
  misc_feature (27)..(27): Xaa is any aa, unknown, or other
  misc_feature (28)..(28): Xaa is any aa, unknown, or other
  misc_feature (30)..(30): Xaa is any aa, unknown, or other
  misc_feature (33)..(33): Xaa is any aa, unknown, or other
  misc_feature (50)..(50): Xaa is any aa, unknown, or other
MLRSALFSSAPGLRRSPTTAHFIXRAXXRXVWXSNGPASAPSRVRLLIGXEVRRVPRRTRTSNFTTPGNEEVGSRIPVTTGDEFKVAGKAPRNGFPGLGKTPVKKGKGVLLKFKNFFRVKMGQIWEKTPLRGGGKPLKM

SEQ ID NO: 33943 - DNA, 675 bp, Zea mays
  misc_feature: Ceres CLONE 1412222-F
  misc_feature: Encodes the peptide sequence at SEQ ID NO. 33944
ggagctccccgcggtggcggccgctctagaactagtggatcccccgggctgcaggaattcgcacgagaccattacctagaacatcctaatcgaaaaacgttccgagacgagagatccttccagaccgaggcgggcgcgcggcagactgtagggtgccctagcaaggatctcgccggccccccagccatggccgaggccgccgacgcgtcgcctcctcctcccaccgccggccgcggagaccgcaagcggggccgagcctcgccagtgctcccgccgccgccgcccgggcccccgccacccggcccgcacaagaagcgtagggaggagggcggtggcggcttcgaccggcgccggctcggcccagtcggcggtggagggcacgaacaggacgacaggaggtatggaaatggtcttggtggtgtaggaggaagaggtggtgatggtcaatatacgaatcgtgcaccagattgtcggaattctgaacggggtggagggaatgagggccccgggaacagtctcaaggaaagattgatgtcattacaacaattccttccggaacttgaaaaatgcgtttcccccagttgaagccccaaggacaaaacggaggggaacaaggccggacctcctccccacctccgaaaaaaaaggctaccttttggcccccctaaaggagtg

SEQ ID NO: 33944 - protein, 132 aa, Zea mays
  misc_feature: Ceres CLONE 1412222-F
MAEAADASPPPPTAGRGDRKRGRASPVLPPPPPGPPPPGPHKKRREEGGGGFDRRRLGPVGGGGHEQDDRRYGNGLGGVGGRGGDGQYTNRAPDCRNSERGGGNEGPGNSLKERLMSLQQFLPELEKCVSPS

SEQ ID NO: 33945 - DNA, 749 bp, Zea mays
  misc_feature: Ceres CLONE 1412233-F
  misc_feature: Encodes the peptide sequence at SEQ ID NO. 33946
  misc_feature (343)..(343): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
aaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggaggcggncgacaagaaggggaggaagaaggcgaagaagagcgtggagacctacaagatctacatcttcaaggtctccgttctcccccaattcgccttcacctcgccgcttcctccttgaccgccaccgttgacgtcgtctttccggcgaggtagctcgccggaagacctcacctggactttttcgacgcaccctccacacactctttaaccctccggaatggccgcctgcttctagctcgtcgacgccccaatctccgcttgcttcctcgacagccccatcccgctcttctcgctctcgctacggctcctctgcctgttcgccatggcgatccgcatcaccgtctcctactccggctacgtggcgcagaaactcgccgcgtcgctcggccaccggtttctctcgnnnctcgct

SEQ ID NO: 33946 - protein, 88 aa, Zea mays; identical to SEQ ID NO: 26553
  misc_feature: Ceres CLONE 1412233-F
  misc_feature (52)..(52): Xaa is any aa, unknown, or other

SEQ ID NO: 33947 - DNA, 654 bp, Zea mays
  misc_feature: Ceres CLONE 1412234-F
  misc_feature: Encodes the peptide sequence at SEQ ID NO. 33948
aagctggagctccccgcggtggcggccgctctagaactagtggatcccccgggctgcaggaattcgcacgagaccattacctagaacatcctaatcgaaaactccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaaggcgctcctggaccgcaaggcccggggccgcgccgccgacaaggctaagggcaagtttactgccgacgacgtcgctgcgccgcccgctggtggcgccgccaccggcgcctctctccaggag

SEQ ID NO: 33948 - protein, 155 aa, Zea mays
  misc_feature: Ceres CLONE 1412234-F
  misc_feature (51)..(82): Pfam Name: KOW Pfam Description: KOW motif
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDKDRKALLDRKARGRAADKAKGKFTADDVAAPPAGGAATGASLQE

SEQ ID NO: 33949 - DNA, 731 bp, Zea mays
  misc_feature: Ceres CLONE 1412239-F
  misc_feature: Encodes the peptide sequence at SEQ ID NO. 33950
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (402)..(402): n is a, c, t, g, unknown, or other
  misc_feature (424)..(424): n is a, c, t, g, unknown, or other
  misc_feature (448)..(448): n is a, c, t, g, unknown, or other
  misc_feature (458)..(458): n is a, c, t, g, unknown, or other
  misc_feature (459)..(459): n is a, c, t, g, unknown, or other
  misc_feature (472)..(472): n is a, c, t, g, unknown, or other
  misc_feature (490)..(490): n is a, c, t, g, unknown, or other
  misc_feature (491)..(491): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (714)..(714): n is a, c, t, g, unknown, or other
aagctggagctcaccgcggtggcggccgctctagaactagtggatcccccgggctgcaggaattcgcacgagaccattacctagaacatcctaatcgaaaaccccaacagaaccgtctccccagtccggcgcctcacgatcgtaatatattgattgcgaaccgcctcgccactttgacgcggcgagtttgtctgagtggcgctagccatgtgacgtgcccgtggcttgcttcgtcgtgatcactagtcacaacagaggcaggaggatctgcttctgctgccgcttcttcttctcctgctgctcttccacagataagtaccgagccggtacagctgactaactgagagggatgccgatgaacgccgcagctcgatacctgccgtacagctacaccgannntcncagggcagggggggggaaaaantggtgggcggggggacgcttttgncgttttgttnnccacaaatcggcncccaaggaacacagcgcnnttgggggaagnnnccgccacccgaaacaagtatcctgctgggccctcgatggatgccccttacttgcgtcgaagagcttgtggccttactttattcccacccggcgaatggtcggagggccaatccggaaattcttacccttgtatcaagtgcccgaacctgtccctcccaagaaattgggggggtttggactttccgggaaaaccctgggttccgccttggnagaacgggggaacaccc

SEQ ID NO: 33950 - protein, 127 aa, Zea mays
  misc_feature: Ceres CLONE 1412239-F
  misc_feature (16)..(16): Xaa is any aa, unknown, or other
  misc_feature (17)..(17): Xaa is any aa, unknown, or other
  misc_feature (18)..(18): Xaa is any aa, unknown, or other
  misc_feature (25)..(25): Xaa is any aa, unknown, or other
  misc_feature (33)..(33): Xaa is any aa, unknown, or other
  misc_feature (37)..(37): Xaa is any aa, unknown, or other
  misc_feature (48)..(48): Xaa is any aa, unknown, or other
  misc_feature (51)..(51): Xaa is any aa, unknown, or other
  misc_feature (52)..(52): Xaa is any aa, unknown, or other
  misc_feature (122)..(122): Xaa is any aa, unknown, or other
MPMNAAARYLPYSYTXXXRAGGGKXWWAGGRFXRFVXHKSAPKEHSAXGGXXRHPKQVSCWALDGCPLLASKSLWPYFIPTRRMVGGPIRKFLPLYQVPEPVPPKKLGGFGLSGKTLGSALXERGNT

SEQ ID NO: 33951 - DNA, 658 bp, Zea mays
  misc_feature: Ceres CLONE 1412240-F
  misc_feature: Encodes the peptide sequence at SEQ ID NO. 33952
  misc_feature (125)..(125): n is a, c, t, g, unknown, or other
  misc_feature (126)..(126): n is a, c, t, g, unknown, or other
  misc_feature (298)..(298): n is a, c, t, g, unknown, or other
  misc_feature (329)..(329): n is a, c, t, g, unknown, or other
tggagctccccgcggtggcggccgctctagaactagtggatcccccgggctgcaggaattcgcacgagaccattacctagaacatcctaatcgaaaaattccaagctctcttcattggttcatanngctagctagttcgcctcccaaaaacacctgccctcgtgcgtggcaggagcacgggcacgatgatcagcacagcgcacagccggcagcagcaccatgccttcgagaagagccctggcaacagccacatgaagagcatcgacaggaagctgcagcaggccatgagccaggcggncagcaagtacatgcagaggatctaccctctnagcatgcagaggagcagctccagcctcacattgtcgtcgctctcgctgtcgcagaactccaacgactcctccatcagcagctcccactccagctgggagcccaggtggcgctgctctacgggggcaccttcaggccatgggggggacgtcatggtgtctcggaaaatgaggggggaagaccataacaaggccagggacatgacgtcaaaggagggaagaggatttggactggaatggagcccggaaccctgcctaggggcaactggatcccccaaaaaaggggagagggggacctccagttccccaaaaagggggggggcgtcccctgg

SEQ ID NO: 33952 - protein, 157 aa, Zea mays
  misc_feature: Ceres CLONE 1412240-F
  misc_feature (38)..(38): Xaa is any aa, unknown, or other
MISTAHSRQQHHAFEKSPGNSHMKSIDRKLQQAMSQAXSKYMQRIYPLSMQRSSSSLTLSSLSLSQNSNDSSISSSHSSWEPRWRCSTGAPSGHGGDVMVSRKMRGEDHNKARDMTSKEGRGFGLEWSPEPCLGATGSPKKGERGTSSSPKRGGASP

SEQ ID NO: 33953 - DNA, 642 bp, Zea mays
  misc_feature: Ceres CLONE 1412241-F
  misc_feature: Translation starting site: 383
  misc_feature (375)..(375): n is a, c, t, g, unknown, or other
  misc_feature (478)..(478): n is a, c, t, g, unknown, or other
  misc_feature (479)..(479): n is a, c, t, g, unknown, or other
tggagctccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggnggcgacaatggagggacgagagatggagaagaaggtgcagcagtacttgcagcgcaggggtttccgcctcactgagcttgcgctccaggaggagtggaaccgnnctctccacctccgccatctccgacgttgggcttggacggtctgacaatgatccagcgagatactacgatggatttagcagattaagaactgggcatacagttcctctgatcaatataagcccgaattacttcccgcctttaacccgttcccatccaaggtcag

SEQ ID NO: 33954 - DNA, 666 bp, Zea mays
  misc_feature: Ceres CLONE 1412242-F
  misc_feature: Encodes the peptide sequence at SEQ ID NO. 33955
  misc_feature (360)..(360): n is a, c, t, g, unknown, or other
  misc_feature (666)..(666): n is a, c, t, g, unknown, or other
ggagctccccgcggtggcggccgctctagaactagtggatcccccgggctgcaggaattcgcacgagaccattacctagaacatcctaatcgaaaaacagatatatatgccgtgaccaaaccgtcgcttccatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcnagccccgcgttcccagcacccgcaagcctaagcctaccaagctcaggtcgaggaatcaaaacacgaggcagtatcctcatctcatgggtttgcaaacaccaacttcatcagtgtactcagctaatggaatttatgggtatgatgggagctatggacccggcctttggtatggatcgcacatgtataattctggattatatggtggatggaattcactgtatgatggaaagtacagaaccagaggaagaggtaacaatgggtattatgtttatggtaatgaaagcatagatggctttaatgagctgn

SEQ ID NO: 33955 - protein, 158 aa, Zea mays
  misc_feature: Ceres CLONE 1412242-F
  misc_feature (1)..(49): Pfam Name: Ribosomal_L6e_N Pfam Description: Ribosomal protein L6, N-terminal domain
  misc_feature (57)..(57): Xaa is any aa, unknown, or other
MAPTSKLSTGIKRASRSHAYHRRGLWAIKAKNGGAFPKADKAAAAVEPKFYPADDVXPRVPSTRKPKPTKLRSRNQNTRQYPHLMGLQTPTSSVYSANGIYGYDGSYGPGLWYGSHMYNSGLYGGWNSLYDGKYRTRGRGNNGYYVYGNESIDGFNEL

SEQ ID NO: 33956 - DNA, 715 bp, Zea mays
  misc_feature: Ceres CLONE 1412246-F
  misc_feature: Encodes the peptide sequence at SEQ ID NO. 33957
tccccgcggtggcggccgctctagaactagtggatcccccgggctgcaggaattcgcacgagaccattacctagaacatcctaatcgaaaaaccacgccaaaacccgcatccataaacaagaataagaaaagaaaacccccgctgccagcgacagaacaagaagggatcccttctccttggttgcgttgcgcctccctcctgtctgcgtgcgagcaatcgatgaacaggcgcgggcgctcgctaccaccacgaccacgacccgatggctttcaagcgctcccgctcagatgcatcttctggcatggcagttgctcctaacattacggagacattcgttgagcttcaaatgaagaaggcattccgatatgttatcttcaaaatcgaagagaagcataagcatgtggctgaggagaagacaggagctactactgaaagctatgatgatgttttggcctctctcccagagaatgactgccgatatgcgctgtatgattttgattttgttactggggagaatgtgcataatagcaagattttcttcattgcctgggccacatcgacatcgcgcatacgtgctaagatggtgcactccacgtcgaaggaccgcatcaagtacgaggttgacgggatccactacgaaatccaggcgaccgacccatcggaggtgcacatcgaggttctccgtgagcgatctcactgagctgcctcatattt

SEQ ID NO: 33957 - protein, 145 aa, Zea mays
  misc_feature: Ceres CLONE 1412246-F
  misc_feature (18)..(145): Pfam Name: Cofilin_ADF Pfam Description: Cofilin/tropomyosin-type actin-binding protein
MAFKRSRSDASSGMAVAPNITETFVELQMKKAFRYVIFKIEEKHKHVAEEKTGATTESYDDVLASLPENDCRYALYDFDFVTGENVHNSKIFFIAWATSTSRIRAKMVHSTSKDRIKYEVDGIHYEIQATDPSEVHIEVLRERSH

SEQ ID NO: 33958 - DNA, 647 bp, Zea mays
  misc_feature: Ceres CLONE 1412252-F
  misc_feature: Encodes the peptide sequence at SEQ ID NO. 33959
tggagctccccgcggtggcggccgctctagaactagtggatcccccgggctgcaggaattcgcacgagaccattacctagaacatcctaatcgaaaaacagatatatatgccgtgaccaaaccgtcgcttccatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgaggaatcaaaacacgaggcagtatcctcatctcatgggtttgcaaacaccaacttcatcagtgtactcagctaatggaatttatgggtatgatgggagctatggacccggcctttggtatggatcgcacatgtataattctggattatatggtggatggaattcactgtatgatggaaagtacagaaccagaggaagaggtaacaatgggtattatgtttatggtaatggaagcat

SEQ ID NO: 33959 - protein, 151 aa, Zea mays
  misc_feature: Ceres CLONE 1412252-F
  misc_feature (1)..(49): Pfam Name: Ribosomal_L6e_N Pfam Description: Ribosomal protein L6, N-terminal domain
MAPTSKLSTGIKRASRSHAYHRRGLWAIKAKNGGAFPKADKAAAAVEPKFYPADDVKPRVPSTRKPKPTKLRSRNQNTRQYPHLMGLQTPTSSVYSANGIYGYDGSYGPGLWYGSHMYNSGLYGGWNSLYDGKYRTRGRGNNGYYVYGNGS

SEQ ID NO: 33960 - DNA, 744 bp, Zea mays
  misc_feature: Ceres CLONE 1412254-F
  misc_feature: Encodes the peptide sequence at SEQ ID NO. 33961
  misc_feature (1)..(1): n is a, c, t, g, unknown, or other
  misc_feature (14)..(14): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (614)..(614): n is a, c, t, g, unknown, or other
nttccccccccccncccccccnnnnnnccccccggtggtggttnnnnnnagatnnnnccaaagctggagctccaccgcggtggcggccgctctagaactagtggatcccccgggctgcaggaattcgcacgagaccattacctagaacatcctaatcgaaaactcctcgcggctcatagaaacctcaaaacccaaccaggacagcgtccacagaaagaagagagagcacatagagtggagtggtggacagaccatggagctctgcgtctctacacccccatcctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtcacggacaagcccgatacgcctgccgacgacaaggccgaggaggttagcgccgcgcctagtggctccgcggaggcgcctatggcagagctggtgccgtcagaggcgtcatcatccccagatgatggcggcctggatgagattctaagcaagnttgcaaaaaaaatggaggctattctcttatcattatgtcttggcaaaagcaaatatggggactcttggcagattgactaccatgatacacttagtgtttacctaagatctgaacattggagtgtctccct

SEQ ID NO: 33961 - protein, 163 aa, Zea mays
  misc_feature: Ceres CLONE 1412254-F
  misc_feature (121)..(121): Xaa is any aa, unknown, or other
MELCVSTPPSSVRATAAPISFAPPRRGASASTAVPPHRRIPTRGWRCASAAVPGPVPSEEPASASYAVVVTDKPDTPADDKAEEVSAAPSGSAEAPMAELVPSEASSSPDDGGLDEILSKXAKKMEAILLSLCLGKSKYGDSWQIDYHDTLSVYLRSEHWSVS

SEQ ID NO: 33962 - DNA, 798 bp, Zea mays
  misc_feature: Ceres CLONE 1412257-F
  misc_feature: Encodes the peptide sequence at SEQ ID NO. 33963
  misc_feature (319)..(319): n is a, c, t, g, unknown, or other
  misc_feature (337)..(337): n is a, c, t, g, unknown, or other
  misc_feature (340)..(340): n is a, c, t, g, unknown, or other
  misc_feature (341)..(341): n is a, c, t, g, unknown, or other
  misc_feature (345)..(345): n is a, c, t, g, unknown, or other
  misc_feature (348)..(348): n is a, c, t, g, unknown, or other
  misc_feature (349)..(349): n is a, c, t, g, unknown, or other
  misc_feature (354)..(354): n is a, c, t, g, unknown, or other
  misc_feature (357)..(357): n is a, c, t, g, unknown, or other
  misc_feature (362)..(362): n is a, c, t, g, unknown, or other
  misc_feature (366)..(366): n is a, c, t, g, unknown, or other
  misc_feature (367)..(367): n is a, c, t, g, unknown, or other
  misc_feature (369)..(369): n is a, c, t, g, unknown, or other
  misc_feature (371)..(371): n is a, c, t, g, unknown, or other
  misc_feature (378)..(378): n is a, c, t, g, unknown, or other
  misc_feature (379)..(379): n is a, c, t, g, unknown, or other
  misc_feature (429)..(429): n is a, c, t, g, unknown, or other
aaagctggagctccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactagccgccatggcgtcgtcgtgcatcccggccggcggcatccggctgctggnactggagatggtcagggncgnngcgncgnncgcgncgncccgncggnngnantcagggnnggtctccacgctctcggagggggtccactcgtccccagcctcctcgtcgncgtttgggggcgttggccctccagggcccgggccagccggggaaaggggcccaaccaaaacgaaaaggagggggggggggtggttcgggcctgggaacccctccgaattcccggcccccgggggttgggggggccccaaggggggccccccccgccttccgggggcttcccctccggtttgggggagaacccgtttgtggtccaaaactctcccctcttttcccctgttcggggagggacagccgcctttccccctgggagggggggggccgggggaagaaaaccccccgcggggtacaaaaaagatgttcccccgcgcgggcgggcaacaaaaatttttatagaaggggcccccccgcgcccctccca

SEQ ID NO: 33963 - protein, 165 aa, Zea mays
  misc_feature: Ceres CLONE 1412257-F
  misc_feature (15)..(15): Xaa is any aa, unknown, or other
  misc_feature (21)..(21): Xaa is any aa, unknown, or other
  misc_feature (22)..(22): Xaa is any aa, unknown, or other
  misc_feature (24)..(24): Xaa is any aa, unknown, or other
  misc_feature (25)..(25): Xaa is any aa, unknown, or other
  misc_feature (27)..(27): Xaa is any aa, unknown, or other
  misc_feature (28)..(28): Xaa is any aa, unknown, or other
  misc_feature (31)..(31): Xaa is any aa, unknown, or other
  misc_feature (32)..(32): Xaa is any aa, unknown, or other
  misc_feature (35)..(35): Xaa is any aa, unknown, or other
  misc_feature (52)..(52): Xaa is any aa, unknown, or other
MASSCIPAGGIRLLXLEMVRXXAXXAXXRRXXSGXVSTLSEGVHSSPASSSXFGGVGPPGPGPAGERGPTKTKRRGGGWFGPGNPSEFPAPGGWGGPKGGPPRLPGASPPVWGRTRLWSKTLPSFPLFGEGQPPFPLGGGGPGEENPPRGTKKMFPRAGGQQKFL

SEQ ID NO: 33964 - DNA, 709 bp, Zea mays
  misc_feature: Ceres CLONE 1412260-F
  misc_feature: Translation starting site: 483
acaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggatccccaagcctcgacgcccgggtagggttttgcctccttcccgccgccgctgtttcagcgagcgagaccgaggggtagagaaagagtggtgcttatccacccatgtcgctgcgtccgagagagcggctcgaggtacggcggaaccgctacaaggtggcgcctagacgcggaggaggggcggcggccatccgaggacaatatggtgtagatccgcaagagccgccgtgaggagagcctcctcaagaggcgccgtgaggtgctccaagtccaggtccctgcccctccctccggggtcgagaagaagcttgaaagcctcccagctatggttagtggggtctattcggatgataataaccttcagcttgaggacaccacacagttccgcagattgctctctatagagaggagtccccccatcgcacaattatcacaacgggtgtagctccaagatttgtgcagtctctcaccagagaggatttcccccagctgcagattgaagctgcatgcactctcacaaatattgctttcatggacttcataacatacaag

SEQ ID NO: 33965 - DNA, 725 bp, Zea mays
  misc_feature: Ceres CLONE 1412261-F
  misc_feature: Translation starting site: 222
  misc_feature: SWISSPROT Homolog: EC 1.4.1.2 Glutamate dehydrogenase
  misc_feature (659)..(659): n is a, c, t, g, unknown, or other
  misc_feature (660)..(660): n is a, c, t, g, unknown, or other
  misc_feature (709)..(709): n is a, c, t, g, unknown, or other
  misc_feature (713)..(713): n is a, c, t, g, unknown, or other
  misc_feature (721)..(721): n is a, c, t, g, unknown, or other
caaagctggagctccccgcggtggcggccgctctagaactagtggatcccccgggctgcaggaattcgcacgagaccattacctagaacatcctaatcgaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccgacgaccaggggaaccgcaccacgccgtcctatgtcggcttcaccgacaccgagtggctcatcggcgacgctgccaagaaccaggtcgccatgaaccccaccaacaccgtcttcgatgccgagcggatgatcggcaggaggttctctgatccgtcagtgcagagtgacatgaagctatggccgttcaaggtcatcccagggactggtgacaagcccatgattgtagtgaatacaagggcgaggagaagcagtttgctggctgaggagatctcctccatggtcctcgatcagaatgaaggagattgctgaaagcctaccttggttccaccatcagaaacgaanntggtgacagtgcccggcctacttcaacgactcgcagaggaggccaccangggnacgccggntttt

SEQ ID NO: 33966 - DNA, 658 bp, Zea mays
  misc_feature: Ceres CLONE 1412264-F
  misc_feature (480)..(480): n is a, c, t, g, unknown, or other
tccccgcggtggcggccgctctagaactagtggatcccccgggctgcaggaattcgcacgagaccattacctagaacatcctaatcgaaaaaacagaaccttcgttccctgccgtctcttgtcggtctggccggccgaggtgggtgatctgtagagcgaaacgccgagccgggagaggagggaggccgcaccggcgattgtagaagcagaaccggtggaggagtagaggagggctccgaatcgatgcgcggctccgcggacgccgtcgtggttgctcgggacgtggtggcctcgtcgagcccgtccaaggccgcgtcggcgttggacatgacgaggtacgcgaatccaccaccaatcccgttcgcctgccgctgcagctgcagctgcagcgttgtgttcgtcggtgttctttcctgagaccaaagccgcgaatttgcgctctcgtttccgcagtcagtggttgttgccggctcctgcggngctgattcgaacaagtttctccctttcgtgccgtgttcgcggcccttctctgctgttctcttcgcaagctcttcgaggcgccgtttgatctgcgggcaggccagttgttctcgcgtctcgcagcctgtgtctcacccgcccacctgtgctggttggttcttcgctggtctcggttcgg

SEQ ID NO: 33967 - DNA, 689 bp, Zea mays
  misc_feature: Ceres CLONE 1412266-F
  misc_feature: Encodes the peptide sequence at SEQ ID NO. 33968
aaagctggagctccccgcggtggcggccgctctagaactagtggatcccccgggctgcaggaattcgcacgagaccattacctagaacatcctaatcaaaaaaccacgttcactccgtatctctcgtgcctttttcctttcctggttgcgacgagccgacgactgggcggacgccgctgccgccctacgccaggtcttcgtcggccccttcgacgagcacacacaagattcagtcgggaatgttgaatgcatagtgtaatttctgcgcaaaaagatggcatcagacgagttcatcagccttgacgcaccttgtgaggctgatgcgaaagatgaagggggagacgttcaggttaaagctcctgatgtgagtgggatggagcctctggtatcggatctccaaccagaagggaaagctgacgctgtggatagtaatcccaagacatctgctggcaacctggatcttgaagaggggcaagtgcaagatatggacctcgcggatgatgacgcagggcccagctacggacaaggaataccaaggtaggatatcggcacagcaaaccgacgccagcgagctgcaagataaactgaagaaggccaaggagcaactgtagcgcgtctccgggacggaggatccttgcgcatcacgacccccagtaggagcgacacccgaccgcgcggcgccacccccc

SEQ ID NO: 33968 - protein, 88 aa, Zea mays
  misc_feature: Ceres CLONE 1412266-F
MASDEFISLDAPCEADAKDEGGDVQVKAPDVSGMEPLVSDLQPEGKADAVDSNPKTSAGNLDLEEGQVQDMDLADDDAGPSYGQGIPR

SEQ ID NO: 33969 - DNA, 697 bp, Zea mays
  misc_feature: Ceres CLONE 1412270-F
  misc_feature: Encodes the peptide sequence at SEQ ID NO. 33970
aagctggagctccccgcggtggcggccgctctagaactagtggatcccccgggctgcaggaattcgcacgagaccattacctagaacatcctaatcgaaaaactgcagtctccagagactagagacctccaccgtccactccaaagacgagcagcggacaaacccaagcacccgcccaatccggttcgccttccttctcaccccgcccggactctgcggagagatctggaagaggagggtatgccattggacgacgacgtggcggcggacttcgcgctgactggacgagctcctgacggcgctgccgcgggacccgtacgagcagctggatctggcgcgccagcatcaccgccgctggcgtcgccgaccaggctgaccggcgtgcagcgcaaggcggggtgcctgcgcgcgaagggcgcgtggaaggaccgcgagagcgccgagctccggaagacaggtgatgctgctcgacaccgcgcttcaggagaccaacgccaggctccgcgccgcgctcaaggacaatattatgctcatcaagaagcgagactcgcatgacgcagacgtccaagaagatgacacgcgacctgcacaggctggagtcattcgagaggcatctgatgcatccaatgcgcgatgatagctcatcaacgcaggagacagtgacattacgacgtgtgatcagccagtagcatacaag

SEQ ID NO: 33970 - protein, 104 aa, Zea mays
  misc_feature: Ceres CLONE 1412270-F
MPLDDDVAADFALTGRAPDGAAAGPVRAAGSGAPASPPLASPTRLTGVQRKAGCLRAKGAWKDRESAELRKTGDAARHRASGDQRQAPRRAQGQYYAHQEARLA

SEQ ID NO: 33971 - DNA, 690 bp, Zea mays
  misc_feature: Ceres CLONE 1412271-F
  misc_feature: Encodes the peptide sequence at SEQ ID NO. 33972
  misc_feature (315)..(315): n is a, c, t, g, unknown, or other
aagctggagctccccgcggtggcggccgctctataactagtggatcccccgggctgcaggaattcgcacgagaccattacctagaacatcctaatcgaaaaatggcatctgcattgcagttgcagccacgccaacaactggggcagacggcgacatctgcatctcccacctcgtctccctcccgtatctgcaagccttgatcccgccgccagccatccatccaagtgagtcatgtctccatccggcgagctgctggcttccatctactccgtactcactgtcgacttcgtcctcctcgcctgcgtcgagctcggngacgccgacgtccgcgccggtggggtctaacggctcatccagtacgacctcgccggggctccgctcgggtcccgcggccgggaccttcaacaacaaggttggcggggttcccgtcccccgccgggggaaaacttttccgggttccgccttgggggggccggtcccttgacctccgggttttctttccccaaaagtacccggggggaaaaaaaaaatcggggggaattacccttccggcccccaaaaaaaggaaaggggggttaaaaggggccaattccaggggggcccgcccggccgcggaaaaatcttttcccgaggaaaagaattatataacagagaatttttgttttgggggaaccaacattttgaacccgg

SEQ ID NO: 33972 - protein, 37 aa, Zea mays
  misc_feature: Ceres CLONE 1412271-F
MSPSGELLASIYSVLTVDFVLLACVELGDADVRAGGV

SEQ ID NO: 33973 - DNA, 746 bp, Zea mays
  misc_feature: Ceres CLONE 1412274-F
  misc_feature: Translation starting site: 459
  misc_feature (683)..(683): n is a, c, t, g, unknown, or other
  misc_feature (686)..(686): n is a, c, t, g, unknown, or other
  misc_feature (689)..(689): n is a, c, t, g, unknown, or other
  misc_feature (696)..(696): n is a, c, t, g, unknown, or other
  misc_feature (699)..(699): n is a, c, t, g, unknown, or other
aagctggagctccccgcggtggcggccgctctagtactagtggatcccccgggctgcaggaattcgcacgagaccattacctagaacatcctaatcgaaaaatgttctgcctccgcaccctccgatcgcccgccgcgtccgattcccctgaccccgcctcgccctcaatctccgccgccgcgcccgcgacatccatcacccccgcccgcgacatcccgcctcgcacgccatcaactcacagcggcccttctccgaacgtggtttgttttttcgtttgctcgagcagccagccgactcgtctccagcaatgcggccggggtcggctcgctggaggtgggcgccgccgccgacacctccaacgcctccaagcagggattaggtgagccgtcggctaatcactcgtcattgggaggatctcctcctcccgttcagatttgggcaagaaaggcccgggcgcgatgtccatggccgaggaggggagtgaggccgaggcgctcgagaaagacggcagcaaggcttcttcaccttcggggccagttaggcgttcctgccgctcttcttcctcccgtgtcgtcagaggaagccgcgaaaagcacgcaggaatcaggcggtcttgaggacgaggagctacaggtgcaggatgcagttgccagtggttccaagaggagcaaagactccgccgncgncgncacacgnagngcccatgtcagctcggccctctgtgggtcactctcaccctgccatcc

SEQ ID NO: 33974 - DNA, 735 bp, Zea mays
  misc_feature: Ceres CLONE 1412279-F
  misc_feature: Encodes the peptide sequence at SEQ ID NO. 33975
  misc_feature (418)..(418): n is a, c, t, g, unknown, or other
  misc_feature (527)..(527): n is a, c, t, g, unknown, or other
  misc_feature (558)..(558): n is a, c, t, g, unknown, or other
  misc_feature (571)..(571): n is a, c, t, g, unknown, or other
  misc_feature (582)..(582): n is a, c, t, g, unknown, or other
  misc_feature (610)..(610): n is a, c, t, g, unknown, or other
  misc_feature (622)..(622): n is a, c, t, g, unknown, or other
  misc_feature (632)..(632): n is a, c, t, g, unknown, or other
  misc_feature (633)..(633): n is a, c, t, g, unknown, or other
aagctggagctcaccgcggtggcggccgctctataactagtggatcccccgggctgcaggaattcgcacgagaccattacctagaacatcctaatcgaagtatctgaccacgtcacacgacaccaccaccagccctccccttcatcaattggagcacggcgcccgttcattcccctcttctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttagttgctgccgttgttgaagacgcgtaactctttagggttcgcganttctcgctgatcggttcgagaattgtaagctatggatctctcgcggcccacatcgtcggacctctcgctcgggctcactctcacggtcacgccacgcccacgctcgaangcacgcggtagcggcgcgctgcggctggtcnacacgcggagganccgaaccggancgggtcctggcccgaaaaggcaacccgnaaagggatgacnaggacggggnnaacaacacttctccctcctgggaactccctcttcctaaagggccgggttgggccggaaacgggggggggggggaaaaaccttatccgggttgtcaagggccc

SEQ ID NO: 33975 - protein, 36 aa, Zea mays; identical to SEQ ID NO: 23807
  misc_feature: Ceres CLONE 1412279-F

SEQ ID NO: 33976 - DNA, 707 bp, Zea mays
  misc_feature: Ceres CLONE 1412284-F
  misc_feature: Encodes the peptide sequence at SEQ ID NO. 33977
  misc_feature (458)..(458): n is a, c, t, g, unknown, or other
  misc_feature (562)..(562): n is a, c, t, g, unknown, or other
  misc_feature (564)..(564): n is a, c, t, g, unknown, or other
  misc_feature (630)..(630): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaaggtgttgcacagaggtcttccggtggcttgtggacctggttgactggtgcgcgttcaaatgaaatacctcctccagatttcacacttccgggagtgactattcctcctccgctgcctgancatggtggaggctggcaaaacaagagtcacaacacttcccaatggtgttaaaatagcctctgagacatctgcgggatcatcttgtttctgttggagtttatggntngattggggggtcggtatatgaagcacctgaaacaacaggtgccagtcaactgttgaagacaatggncttcacaacatgccaacaggaangggagttggttgtgcgtgaaatgaggaaataggtggcagtggcaagcatctgct

SEQ ID NO: 33977 - protein, 65 aa, Zea mays
  misc_feature: Ceres CLONE 1412284-F
  misc_feature (49)..(49): Xaa is any aa, unknown, or other
MLQLGVPAQGVAQRSSGGLWTWLTGARSNEIPPPDFTLPGVTIPPPLPXHGGGWQNKSHNTSQWC

SEQ ID NO: 33978 - DNA, 706 bp, Zea mays
  misc_feature: Ceres CLONE 1412286-F
  misc_feature: Translation starting site: 115
  misc_feature: Pfam Name: DUF506 Pfam Description: Protein of unknown function (DUF506)
  misc_feature (222)..(222): n is a, c, t, g, unknown, or other
  misc_feature (223)..(223): n is a, c, t, g, unknown, or other
  misc_feature (226)..(226): n is a, c, t, g, unknown, or other
  misc_feature (405)..(405): n is a, c, t, g, unknown, or other
  misc_feature (555)..(555): n is a, c, t, g, unknown, or other
tggagctccccgcggtggcggccgctctagaactagtggatcccccgggctgcaggaattcgcacgagaccattacctagaacatcctaatcgaaaaaaacacacacacagaccatggtgatggaggagacgatagacgacagtgagatgagcttgtcgaacatggtgctgggcttcctggaagatttcgagagggacgagcgacggccggagaacgacacnnacnacaacgaggaggagggctccagcggcggcgacaccgccgagagcaaggccttctggcagacccaacacttgcagctgcgcgaggcactggccaagggcagcccagccgagagcaggatccgcgcggacacggaggaggccgtcaagagcatgcgcgccgcggcctgctcctgctcctgncacggggcggcccgccgcccgggactgccggccgtgcatgctccggcacgtcgccgaccggctgcgcgacgccggctacgacagcgcgctctgcaaatccaagtggacgcgctcgccggatatcccttcaggcgagcacagctaactggnagggtggcggtgcagacgaggagcggcaaggccgtgccccgttggtggtggagctcacttccgcgcgagggtttcaagggtggcgcggcgccagcgccggctaccggcgcgctggtgacggctttgccccgaggggggttcggtcggccgg

SEQ ID NO: 33979 - DNA, 646 bp, Zea mays
  misc_feature: Ceres CLONE 1412287-F
  misc_feature: Encodes the peptide sequence at SEQ ID NO. 33980
  misc_feature (280)..(280): n is a, c, t, g, unknown, or other
  misc_feature (378)..(378): n is a, c, t, g, unknown, or other
  misc_feature (387)..(387): n is a, c, t, g, unknown, or other
  misc_feature (388)..(388): n is a, c, t, g, unknown, or other
  misc_feature (390)..(390): n is a, c, t, g, unknown, or other
  misc_feature (438)..(438): n is a, c, t, g, unknown, or other
tggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagncggctgctcccgctgcgggacatcatcgagtgccgctacgtggaggagacgggcttcgtgtggctccggcagcgccgcaaggtggaccactacttcgncaaggcggnncncaccgtggcctacgggggccagggtggccgcggtgggcgaaaaaaggnccggttcagaaaaattcccggcgggcaaaggccaaggaaaatgctgcttggggggcccccccccaccgagaaatgggggggaaaaacccgggcccagtggataaatccccctgtgaaggccattcgggggggcggttccccccgatttcccccgcaaggggcttttaaggcccaaaaaaccccgggcccccccgaaaccggtgtgcct

SEQ ID NO: 33980 - protein, 159 aa, Zea mays
  misc_feature: Ceres CLONE 1412287-F
  misc_feature (37)..(37): Xaa is any aa, unknown, or other
  misc_feature (70)..(70): Xaa is any aa, unknown, or other
  misc_feature (73)..(73): Xaa is any aa, unknown, or other
  misc_feature (74)..(74): Xaa is any aa, unknown, or other
  misc_feature (90)..(90): Xaa is any aa, unknown, or other
MTLTIPDEVRAKAEVYVGDAAGQEKTRLLLQETGLPXRLLPLRDIIECRYVEETGFVWLRQRRKVDHYFXKAXXTVAYGGQGGRGGRKKXRFRKIPGGQRPRKMLLGGPPPTEKWGGKTRAQWINPPVKAIRGGGSPRFPPQGAFKAQKTPGPPETGVP

SEQ ID NO: 33981 - DNA, 725 bp, Zea mays
  misc_feature: Ceres CLONE 1412289-F
  misc_feature: Translation starting site: 217
tggagctccccgcggtggcggccgctctataactagtggatcccccgggctgcaggaattcgcacgagaccattacctagaacatcctaatcgaaaaagttggaccggccgttgttgctttgcgtcttcgccaaaaacagaataagcttgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggagatggatcagtcgacttttctggaaatcctgttgtcaaggaaagaacgggtagatggaaggcatgtccattcatattaggtaatgaatgctgtgaacgactggcctactatggcatctccacaaaccttgttacttacttgacaaaaaaactgcatgctggcaatgcctctgctgctagcagtgtgactacatggtcgggaacttgctacttaactccacttattggagcaatcctggctgatgcatactgcgggaggtactggacaatcgccacattttccacagtatacttcattcgggatgacactgctgactctttcagcaccagttcctatgctcatgccttcatcctgggaaggatctttttgcccagcagcagccccttttcagaatactgcctttttttctggcctttaactga

SEQ ID NO: 33982 - DNA, 723 bp, Zea mays
  misc_feature: Ceres CLONE 1412290-F
  misc_feature (273)..(273): n is a, c, t, g, unknown, or other
  misc_feature (279)..(279): n is a, c, t, g, unknown, or other
  misc_feature (280)..(280): n is a, c, t, g, unknown, or other
  misc_feature (475)..(475): n is a, c, t, g, unknown, or other
caagctggagctcaccgcggtggcggccgctctatactagtggatcccccgggctgcaggaattcgcacgagaccattacctagaacatcctaatcgaaaattgctcgacaggcttcccagttaagagatacctttctcctgcgattaccgaaccactcgcttcttgtctaatgcccgtcgctatcaccaattcagcataatgccagtgctgccgttgctgtccgcaaagccatcccctccctgcacgccccctcggcccggtggtgagtggnaggcgnnctaagaattccagggtgaggagcgcccggaccggggtcaagttttattgagccacgccaggacccggcgccgtgatccctctttttttttttgccccccccccggcgggccttcgtattttgctagggacgcccgcggagacccccgccttccccccaccccccgtaacaaccatgccggctcccgcgccagagnccgcccaacttcccccggaccctcaaacccgtttgcactctattgggcgacctcccgaaccccaaacgacccccctgctaccgccgcccaaacgccgctccgggcctccccaccgcctacatgtattaccgcccacacagctccgccgcccccgccccacatccccctgtgttctgcgaacccgtggaatgttgccgctatcccgtgaatggattccacgcgaacccaagccctgttcttcacctcgc

SEQ ID NO: 33983 - DNA, 657 bp, Zea mays
  misc_feature: Ceres CLONE 1412292-R
  misc_feature: SWISSPROT Homolog: EC 2.7.1.4 Fructokinase
  misc_feature (534)..(534): n is a, c, t, g, unknown, or other
acgattgggtaccgggccccccctcgaggtcgacggtatcgataagcttttttttttttttttttagggcaagcaaaaaatggcaggtaagatggagcacccacttcttctgttccagatcagaatacaatacattttgcaatttgcagaagtggaagctagtgaaaaccaaagcaattacagtgatctatctatgccttctctattagctgcaagacctcagtttcagtgggcaaagacgggatcgcacccttcttcgtggcggtgattgctccacacgcattagcgaatttaatagactctacaagcttcttctcgtcttgtagcgaggatggatctttaacgatccttcggagcagcgcaccaacaaacgcatcgcctgcgccagtcgtatcgacttgttgtactttgaaggaagggacagctccatggaaatccctggtatagtacttgcatccttgatctccaagagtcaccaggagcagcttcatggtaggtcgccacagcttcatgacaacatcgtcctccactgangtgatgccctgtcagaatcaagctcgacttcgctgactttgacaatatctgcctgggtcccagatgctcaggatctgggtgcgggcctctcacgggatggcaatgggcccccctcagttttgg

SEQ ID NO: 33984 - DNA, 688 bp, Zea mays
  misc_feature: Ceres CLONE 1412292-F
  misc_feature: Encodes the peptide sequence at SEQ ID NO. 33985
aaagctggagctccccgcggtggcggccgctctagaactagtggatcccccgggctgcaggaattcgcacgagaccattacctagaacatcctaatcgaaaatttttttttttttttttccccacacgcgcccacctcctccggacctcccctctagtcctctctcccgaccccacctctgccgtcagggcgtccgtccggtaaccgcgagctaacaatggcgcccgtttcgcagagctgctggtgagttccgataagatgctgatatacttcgtgccgaccgtggcgggggtctcgctggtcgaggcgccggccttcctcaaggtggacgggggcgcgcccgccaacgtctgcatcgtgacctcgagcctcggtggtggggccgccttcgttggcaagatcgccgacgacaagttcggtggattgatcgccgccatcctccgcgacaccggagctaacggaggttgtgttatcttcgattggtgcgtacgcacagcgattgcattctcttccattcgagcagatagggagagtgagctctgcttctactgtagcccagcgacgactagctcctcactggctacgagctgaataccggcatcatccggatggctgcagcatctgactacgttgaactacgcctgattgttgacacttgcagaactactactcttcaggcagtgtaatg

SEQ ID NO: 33985 - protein, 110 aa, Zea mays
  misc_feature: Ceres CLONE 1412292-F
  misc_feature: SWISSPROT Homolog: EC 2.7.1.4 Fructokinase
MLIYFVPTVAGVSLVEAPAFLKVDGGAPANVCIVTSSLGGGAAFVGKIADDKFGGLIAAILRDTGANGGCVIFDWCVRTAIAFSSIRADRESELCFYCSPATTSSSLATS

SEQ ID NO: 33986 - DNA, 751 bp, Zea mays
  misc_feature: Ceres CLONE 1412293-F
  misc_feature: Encodes the peptide sequence at SEQ ID NO. 33987
  misc_feature (751)..(751): n is a, c, t, g, unknown, or other
aagctggagctccccgcggtggcggccgctctagaactagtggatcccccgggctgcaggaattcgcacgagaccattacctagaacatcctaatcgaaaaatccgctgcctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagaccctttctcttcggtgaaaagcccggtcaccgtcttttggcatcaggaaaccctggaggaaatcccggtgggggtgagggctgggcccttgagtatgtgtcggggagtcccaccgggggtcctttccctgaacaaaggacaagggttggctggaacattctcaaaggggggggggccaaaaaaagggttgggttattttcttggccccccaaggaaaaggaccccccccctttgttttttgttggtttgggggcccaatgggggccaaaaggcacccccccggggagggtgtaaaaattttggttttccacaaggggtatgatttggaaaccaaaaaaaagtgggctttgggccccccctctgtgtagaaaggggcctn

SEQ ID NO: 33987 - protein, 72 aa, Zea mays
  misc_feature: Ceres CLONE 1412293-F
  misc_feature (4)..(73): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLSLR

SEQ ID NO: 33988 - DNA, 692 bp, Zea mays
  misc_feature: Ceres CLONE 1412294-F
  misc_feature: Encodes the peptide sequence at SEQ ID NO. 33989
ccagctggagctcaccgcggtggcggccgctctatactagtggatcccccgggctgcaggaattcgcacgagaccattacctagaacatcctaatcaaaactttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggtcgcggtagagagcctccagccggggatggagagtctgaatgcgcaggagcgcgaggacgcgcctccggccaagggcgagaccccccccgccgtatggagtttgccgtcgtcttccgcagaacctgccggagccagacgaacaggacgagatgatgtctcaaggtgtcaaattggaatgatgcccaccgcccccgatggttatggcgtgaactccatcttctgccgcccgatagcctcagccatctctcggggttaatggaggcacctaacgactgccctcgcccccccggggtctctccaagacaatattaggaggcaaacggtcgtcgcgcaacgaccgaacgccccccccccttac

SEQ ID NO: 33989 - protein, 111 aa, Zea mays
  misc_feature: Ceres CLONE 1412294-F
MAAVGSLKPGMETLHVQDYKDAPPAKVAVESLQPGMESLNAQEREDAPPAKGETPPAVWSLPSSSAEPAGARRTGRDDVSRCQIGMMPTAPDGYGVNSIFCRPIASAISRG

SEQ ID NO: 33990 - DNA, 653 bp, Zea mays
  misc_feature: Ceres CLONE 1412296-F
  misc_feature: Encodes the peptide sequence at SEQ ID NO. 33991
  misc_feature (456)..(456): n is a, c, t, g, unknown, or other
gctcatttccagaggatcccccgggctgcaggaattcccacgagaccattacctagaacatcctaatcgaaaaaacccggctgtgctgtctcgtcgccttcctcccctcctgccggctgctgccgccgccagccgctgcaggcacgcttgccctctgctccctgtccatccactcatcattccccgtcatccaccaattcacaacccaaaaccctaaacccatttacctcaacgccaccgccgccgccgcgatgcagtccatggcgcccacctctccctcactcccggtggcaggccccgttccccgccgccgcctccagcgcgtccgcgccgttttggtctccgacgagcccaaactcaacaagtacagcgcgcgcatcacggagcccaagtcgcagggcgcctcgcaggccgtgctctacggggttggcctcaccgacgccgacctccgcaagncgcaggtcggcgtctcttaggtgtggtacgaagggaaacactgcaacatgcacctgctccgcctcgccgaggccgtccgcgacggcgtcccgtgaagccgggaatggccggtttccgattcaacaccggccggggcagcgaagcccatctcccagggaacccggggcaatgggttaaagccttcaagtcccgggacc

SEQ ID NO: 33991 - protein, 74 aa, Zea mays
  misc_feature: Ceres CLONE 1412296-F
  misc_feature: SWISSPROT Homolog: EC 4.2.1.9 Dihydroxy-acid dehydratase
  misc_feature (69)..(69): Xaa is any aa, unknown, or other
MQSMAPTSPSLPVAGPVPRRRLQRVRAVLVSDEPKLNKYSARITEPKSQGASQAVLYGVGLTDADLRKXQVGVS

SEQ ID NO: 33992 - DNA, 670 bp, Zea mays
  misc_feature: Ceres CLONE 1412297-F
  misc_feature: Encodes the peptide sequence at SEQ ID NO. 33993
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
aagctggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33993 - protein, 104 aa, Zea mays
  misc_feature: Ceres CLONE 1412297-F
  misc_feature (3)..(154): Pfam Name: PGK Pfam Description: Phosphoglycerate kinase
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEERG

SEQ ID NO: 33994 - DNA, 696 bp, Zea mays
  misc_feature: Ceres CLONE 1412298-F
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataaacagggggccgggaacagctgactaactgaaaagcatggagatgaacgccggtggggggaaaattgccataaaaactaccccggccacgcagaaccggggtaaactcgttgaaaagaggtaacccgcgtgagaccccccaagtttctgacgggccccatgtggggggttttcccggggggcccctgggccttattttccccccgcgcaattttaaccccccttcaaaaatttcttaaaaaccccaaccctcttcttaagaaagagggggtgggggtcnaataataatataggggggagggggggggccccccccgcagatacacctcttttctttccacgggggagataatttattttgcgccggtcatcttcactgagg

SEQ ID NO: 33995 - DNA, 694 bp, Zea mays
  misc_feature: Ceres CLONE 1412300-F
  misc_feature: Translation starting site: 244
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (636)..(636): n is a, c, t, g, unknown, or other
aaactggagctccccgcggtggcggccgctctagaactagtggatcccccgggctgcaggaattcgcacgagaccattacctagaacatcctaatcgaaaaatctcctcgcgagcaccgctggcctcgcttaacggcctgatctcccagccgccgcttccgcctcgcgtcccaccggtctccatctacatgcagccgcgcttcgccaccgccgtcggaggcgcctgcgccctccgacgccatcatgatgcccggcgtgggcggcgtggagccggccgtcacgttgggccaggtgccgcgctggagcgaccccgaccagcgcatcttcctcgcctccacgtccgaagaggcgtccgcggaggacgacggatccggcacgacctctgcgtctggcttcattctctttctccgacccgctcacggtcgacgacggcgccgtcgggggtggccacgccgggggtgcctcgcgcttccccgtcgaccaggagatcaactctaggatctattctctggcgtggccagccctggaacctcgaggtcgacgcggtcgtcaattctaccaacgagagcttggacgaggcgcacagtagcccggggttgcatgctgctgccgggtcagtccgnnnnaaannnnngngcaccacctttgggaggttgccgaactgggatggccaagatgaccaatgcctacgatc

SEQ ID NO: 33996 - DNA, 716 bp, Zea mays
  misc_feature: Ceres CLONE 1412303-F
  misc_feature: Encodes the peptide sequence at SEQ ID NO. 33997
  misc_feature (643)..(643): n is a, c, t, g, unknown, or other
  misc_feature (707)..(707): n is a, c, t, g, unknown, or other
aagctggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaaggtaattagctcaaggatcgtcagagatcgtgcccaccctttggcctttattcaggaatttgaatctttagttaggatcgttccatacagtgggatcccgtctaggctttgttcggttttcacggattggagacccagaataattcctagccggattacttctctaatttatataaattttgatgagttggaacgaaaccgggtttattccaatagaaacgaacggccccctaggaaatggagaagtcccccccggccgatcttgagnattaagactctttctgtttcttgccattgtccgtcctgtgcatgccttgcttggacgccgcagntccccctgc

SEQ ID NO: 33997 - protein, 157 aa, Zea mays
  misc_feature: Ceres CLONE 1412303-F
  misc_feature (133)..(133): Xaa is any aa, unknown, or other
  misc_feature (155)..(155): Xaa is any aa, unknown, or other
MKFMRLGTRPDTFFTAADSVRSVCTEVATDLQILVDNCLYHLHKVISSRIVRDRAHPLAFIQEFESLVRIVPYSGIPSRLCSVFTDWRPRIIPSRITSLIYINFDELERNRVYSNRNERPPRKWRSPPRPILXIKTLSVSCHCPSCACLAWTPQXPL

SEQ ID NO: 33998 - DNA, 869 bp, Zea mays
  misc_feature: Ceres CLONE 1412305-F
aaagctggagctccccgcggtggcggccgcattcgaactagtggatcccccgggctgcaggaattcgcacgagaccattacctaaaacatcctaatcgaaaaaattgtgtcgattttgacatgcacgtagtacgctgggatccttcgcatagaccggattacaactgtagggcctagccaccgcccaccgtcgcctcagaaaatcctcctcccgtttcaccatgccgccctgctgctcccccaccacctccgccgtcaccgctgcggtggcatctcccggcgcctcgcgcagcggtccgcctcccccccccttcccctttttccccccttccgccccctcggctggaactttgccgcccccgctctccttctcggcgttcgccgctctattcgtggtcctccgtttcgcgaacgtgcatcggcccccccgtctatgcgcactctaccgttcccccccgtggcgccccttaccgccggggaccactctcgtcttggcactgtgggcgacgcgatgccctggattgccacatcccggctcgttttcccgcctagaagactgtccccgagtaggtactgccgccccagggcgctctccctgcccgtgtaaatgcatctactcagctggaactcgctggcggcggcctgccgccgcgctttcctgaataggcgccccgccccctctaatgtgactcgctgcccgtctcgtgcgacgggccgtgactcataacccaacgtacccgctcagcccgaccggtgcggcgcgtggaaccgcggataatgtgccttattgataacggttcgacgctgcgccgcccccgaaccccgccgatcgcccatcgaattcctctcccgcgcgccttctcggaccg

SEQ ID NO: 33999 - DNA, 695 bp, Zea mays
  misc_feature: Ceres CLONE 1412307-F
  misc_feature (337)..(337): n is a, c, t, g, unknown, or other
tggagctccccgcggtggcggccgctctagaactagtggatcccccgggctgcaggaattcgcacgagaccattacctagaacatcctaatcgaaaaattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgcggcggncagggctgcagcagcagccggcagcgcgtgcatcttgcgaccccctttccaagaaccagctgcaagctttggccttttccgcctgccgtacccgaaatcccgcaagaaactccacccaagaaaaaagcggcgcccttttggctggctggctgccattcctcacgccccacgagtttggtgaggttttgaaacgagcacagttcacaagacagtgaggctgcggtgggtgtttcctcgtcggagatggaggaaatttgccgccgaaaacatggtccaggcggaggcccctcgatctggggcagccggtcccttcgcccgccaccccaggggctcagggttaccaggatgtcttcgttgc

SEQ ID NO: 34000 - DNA, 786 bp, Zea mays
  misc_feature: Ceres CLONE 1412310-F
  misc_feature: Translation starting site: 205
  misc_feature: SWISSPROT Homolog: EC 2.4.1.115 Anthocyanidin 3-O-glucosyltransferase
  misc_feature (554)..(554): n is a, c, t, g, unknown, or other
  misc_feature (566)..(566): n is a, c, t, g, unknown, or other
  misc_feature (567)..(567): n is a, c, t, g, unknown, or other
  misc_feature (573)..(573): n is a, c, t, g, unknown, or other
  misc_feature (586)..(586): n is a, c, t, g, unknown, or other
  misc_feature (591)..(591): n is a, c, t, g, unknown, or other
  misc_feature (680)..(680): n is a, c, t, g, unknown, or other
  misc_feature (683)..(683): n is a, c, t, g, unknown, or other
  misc_feature (688)..(688): n is a, c, t, g, unknown, or other
  misc_feature (692)..(692): n is a, c, t, g, unknown, or other
  misc_feature (744)..(744): n is a, c, t, g, unknown, or other
  misc_feature (745)..(745): n is a, c, t, g, unknown, or other
aaagctggagctcaccgcggtggcggccgctctagaactagtggatcccccgggctgcaggaattcgcacgagaccattacctagaacatcctaatcgaaaaaggttcttgtcgactttacatatcttctctgatagccttcgtagtgaagagtaggatgagccaccctcctccacggcgttcctgcaggcatccctcatctccatggccttctccctcgccttcctcccttcctcgccaccgcccatcagctccttcaccgctcgctccagctccgaggcctccacgaaattgttcctcttcctgtccaccttcatcgccacggcgacgcctacataggccaccagcgtgaacgcgttcaggtgctgctcggcgtacagcggccacggtgccatcggcaccccgaaccacaggctctcgagcaccgagttccagccgccgtgtgtcacgaaaccaccaacggcggcgtgggctagtatctctttctgcggcgccttcgtcggccacaccaggcctctgcccttggtcctttcgaggaatccatcggggagagnctcggagagtcnncggttncgacgggtgccgnctcgncggggtggccggtgggccgcgcagcacaaaagaaggaaagcggtggccgctacgcttcagggccgtggcgcgatcctcgtggcgctggntgncgccngcgnagaaaccttgggctccccgaagcagaggaagcacaccgggagggccgccggnnctggcgtgtcgaagcaccgcacgcaatctctggggggggga

SEQ ID NO: 34001 - DNA, 707 bp, Zea mays
  misc_feature: Ceres CLONE 1412311-F
  misc_feature: Encodes the peptide sequence at SEQ ID NO. 34002
  misc_feature (7)..(7): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
tttttgngggtggggnngnntgggtgggtggtggagagattaacaatcaccttaaaactggagctccaccgcggtggcggccgctctagaactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatgcacaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctccgtgagctgatacgcgacgctgccatcgttcacggtgacgtgctaaacaccatcccggcgcgtgggccgacgcccgacccggcttt

SEQ ID NO: 34002 - protein, 124 aa, Zea mays
  misc_feature: Ceres CLONE 1412311-F
MGKKRKLEPKSAAGFTPVKASPTTRSATAKAAGLSEVLAPVEATMHKLPQGAGGEDVEEIEEVEVEEEVEVEEEEEGESDQASIQALLDSFPKDQLRELIRDAAIVHGDVLNTIPARGPTPDPA

SEQ ID NO: 34003 - DNA, 657 bp, Zea mays
  misc_feature: Ceres CLONE 1412312-F
  misc_feature: Encodes the peptide sequence at SEQ ID NO. 34004
aaagctggagctccccgcggtggcggccgctctagaactagtggatcccccgggctgcaggaattcgcacgagaccattacctgaacatcctaatcgaaaaacactacatcccacctacctcctcgcatcaggcaggcgggcctcgcgtttataagccacccttcctctcctccacggccctcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcatcgctcacgctcgcggcgcgcggcggggccggggccggcgcgcgtctccgcgtgcggagcgcgatcttgtcgtcgaccgcgcccgtgccgcccaccgagtccaggccgacccgccggatctcgacgtccgcatcggacggcacgctaggggcccagactgcggtgctggacgcccagaatctgaacgatcccgagctgggcatgctgcagctcttcgcggactcggagcgcgcctacggcctgtaccccgcggagctcctcgcaaaggagaagaagttctacacgctcatcgtgcgaagagtgaccaaggagactcgttaa

SEQ ID NO: 34004 - protein, 134 aa, Zea mays
  misc_feature: Ceres CLONE 1412312-F
MAASRALLPSPQVSPASARVRLAAAVPSSLTLAARGGAGAGARLRVRSAILSSTAPVPPTESRPTRRISTSASDGTLGAQTAVLDAQNLNDPELGMLQLFADSERAYGLYPAELLAKEKKFYTLIVRRVTKETR

SEQ ID NO: 34005 - DNA, 591 bp, Zea mays
  misc_feature: Ceres CLONE 1412313-F
  misc_feature: Encodes the peptide sequence at SEQ ID NO. 34006
  misc_feature (271)..(271): n is a, c, t, g, unknown, or other
  misc_feature (327)..(327): n is a, c, t, g, unknown, or other
  misc_feature (434)..(434): n is a, c, t, g, unknown, or other
  misc_feature (435)..(435): n is a, c, t, g, unknown, or other
aaaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcatagctagactatgacgctgacgatcccggacgaggtgcgcgccaaggcggaggtgtacgtgggcgacgcggcggtgcaggagaagacgcggctgctccctccaggnagacggggccctcccgagcgggctgctcccgctgggaacaatcatcgagtgggggntacctggaagggaaccgggcttttcgggggggtcccggcgacgccccccaagggggggcaccattaaatttccaaagggggggggcccccccgggggtccaaaaaanncccccaagggggggtttccgggggggggcccccaaaaaagggggcgcccctccaaaaaaaaaaaaaaaaacgggggtctcccgccccggggaggggggatttttttttttgggggggccccccccccccccccccaagagggggtgggggggcccc

SEQ ID NO: 34006 - protein, 72 aa, Zea mays
  misc_feature: Ceres CLONE 1412313-F
  misc_feature (51)..(51): Xaa is any aa, unknown, or other
MTLTIPDEVRAKAEVYVGDAAVQEKTRLLPPGRRGPPERAAPAGNNHRVGXTWKGTGLFGGVPATPPKGGHH

SEQ ID NO: 34007 - DNA, 687 bp, Zea mays
  misc_feature: Ceres CLONE 1412322-F
  misc_feature: Encodes the peptide sequence at SEQ ID NO. 34008
  misc_feature (323)..(323): n is a, c, t, g, unknown, or other
  misc_feature (326)..(326): n is a, c, t, g, unknown, or other
aaagctggagctcaccgcggtggcggccgctctagcactagtggatcccccgggctgcaggaattcgcacgagaccattacctagaacatcctaatcgaaaaagttaagtctcgttcactgcctgtgctgctcagtgctctgctcacacatcctcgtcgccaatggcggctcccgtccgggccatcccgctcccgtcgcccgtcctgtacccccgcatgtccttatggggccgcagcagctgcagccggcgacgtgcccccggagttcgcgcagcagtggaggcggcggagggtgcttcgcgggcgacggagcccgcggaggnggncggccccccccgccggccgggcgccgccctttatttctgcctgggcgcaggcgtggcggcctcccccttcttccttatctccccccccccgcggtcggaaactttcacacctcccggcgacccccccgggatgacaatggttgtacgctccacacatccgcccctcggcactgctccccgcctttaattcccctcgtaccctccccgtccccacatcacatagcgcctcttataagttaccgcttggattcgggggtatttatctattgccggcgccgggcgcccaataggccgtaatgtgtaattattttcaacctctctccgcttccccgcactcctatttctccccccccccacccgc

SEQ ID NO: 34008 - protein, 116 aa, Zea mays
  misc_feature: Ceres CLONE 1412322-F
  misc_feature (54)..(54): Xaa is any aa, unknown, or other
  misc_feature (55)..(55): Xaa is any aa, unknown, or other
MAAPVRAIPLPSPVLYPRMSLWGRSSCSRRRAPGVRAAVEAAEGASRATEPAEXXGPPRRPGAALYFCLGAGVAASPFFLISPPPRSETFTPPGDPPGMTMVVRSTHPPLGTAPRL

SEQ ID NO: 34009 - DNA, 789 bp, Zea mays
  misc_feature: Ceres CLONE 1412324-F
  misc_feature (550)..(550): n is a, c, t, g, unknown, or other
  misc_feature (552)..(552): n is a, c, t, g, unknown, or other
aagctggagctccccgcggtggcggccgctctataatagtggatcccccgggctgcaggaattcgcacgagaccattacctagaacatcctaatcgaaaaaagtaacctctcgtgctcgggcactttctttttccttcccccctgtgcgctcggccgcctccgtcgctgcctcgctccctccgcgcccaccacggaggcgcacgcgcgggcgcagcgtccctcgcgtgcctcgacttccgtactgctctgtccgcccgcctggatcctgaatcctcctactcctcctcgtctagggctaggagacgcgtcgcgatgccccacggtgcatctccccccagcgccagctagtcgctatacatcctcccccaccctcaactactcgacgatccctcgaaaaaaggcctgatccactaaccccccaccacccaccccattccttgtttagcggggcagcccttagaagcaccccccctcttcccccttaatccccatcctcgctcgacacgcatatatgtccttccaacacccctcgcaactctttcacccccntnccccgcataacgaaacttccatgtattcctacgccctcttccaagggtaccgacactaagcccctaaccctatacaccccttaaacccgtattattctcgcccttgtatactcctgggcacctaatctcctccgctgccgcggcacctcccccctcacgtcgacctccccccgcccaccatctcattttatacccccctcaaccgctcccaccttatgcaattaaccctctcttagc

SEQ ID NO: 34010 - DNA, 666 bp, Zea mays
  misc_feature: Ceres CLONE 1412325-F
  misc_feature: Translation starting site: 361
  misc_feature: SWISSPROT Homolog: EC 3.1.3.16 Phosphoprotein phosphatase
  misc_feature (514)..(514): n is a, c, t, g, unknown, or other
ctggagctccccgcggtggcggccgctctagaactagtggatcccccgggctgcaggaattcgcacgagaccattacctagaacatcctaatcgaaaaatatgtttattaaaaataaaaatgtccgctgcttgcttcgtcccgttctggcgttcacacctctggctgccttcatttcctgttgacgactgagcgggcgagcgccggcgccctttgccaggtccgtcggcccgttagccggcgactagcgcctccctttgccaggtcttcgacgtccccttcgccgtcgactggcgcccagcagccagcagcagatccttttctatctgtcgtgttctgtctgcctggtacatttggaagaatgggggtttaccttagcactccgaaaactgagaaggtatccgaagatggggaaaatgataaacttaaattcggagtttcatctatgcaagggtggcgtacaactatggaagatgctcactcggctttgctagatctcgacaatgacactgcgnttttttggtgtttttgatggacatggaggaaaagtagtcgccaaattctgtgcaaaaatctacacagagaagttctcaggagtgaagcctatgcagctggtgacctggggtgctgctgtccacagagcttacttcagaatggatgaaatgat

SEQ ID NO: 34011 - DNA, 675 bp, Zea mays
  misc_feature: Ceres CLONE 1412331-F
  misc_feature: Encodes the peptide sequence at SEQ ID NO. 34012
  misc_feature (485)..(485): n is a, c, t, g, unknown, or other
  misc_feature (550)..(550): n is a, c, t, g, unknown, or other
  misc_feature (551)..(551): n is a, c, t, g, unknown, or other
aagctggagctccccgcggtggcggccgctctagaactagtggatcccccgggctgcaggaattcgcacgaaaccttaactaaaacattccaattcaaaaaatcagagatctgtagaccaccacggcttgaacctagcccggacaccattcataacaggtcatgtccatgggctccccggagctgctcacgcagctgaatcctctgtaccagttcgaggtgaacaaaatcctggacatcgaggccgtgtcgctcgccaccgcggtactgctcataggatacgtcgctcgcgcccgaggagatactggcgctccagacaggcgctacctggtcctgctcgcgatcctgtctgccgtgtgcacggtgctgtacctgatgctcacagcccgcgctgggtgatacctgatgtactacacgtgcttccgcaccagccccaactgtcgcgtcccgtatcgacgtacgatcctgtagcactcccgcgtgtgnaccgggcttcgacgagcgcagtgtccggttcatgacttcctagctgaaagcggtcatttctcggnntaccatacctgcctgtcgtatcagaaggactacatccagacgtcgcgagatgtgtaatactcgcgcgccgaggtcgaaatagacatcttctcggccatcgactatctgctcaaccaagaccggc

SEQ ID NO: 34012 - protein, 78 aa, Zea mays
  misc_feature: Ceres CLONE 1412331-F
MSMGSPELLTQLNPLYQFEVNKILDIEAVSLATAVLLIGYVARARGDTGAPDRRYLVLLAILSAVCTVLYLMLTARAG

SEQ ID NO: 34013 - DNA, 729 bp, Zea mays
  misc_feature: Ceres CLONE 1412333-F
  misc_feature: Encodes the peptide sequence at SEQ ID NO. 34014
  misc_feature (283)..(283): n is a, c, t, g, unknown, or other
  misc_feature (303)..(303): n is a, c, t, g, unknown, or other
  misc_feature (304)..(304): n is a, c, t, g, unknown, or other
  misc_feature (329)..(329): n is a, c, t, g, unknown, or other
  misc_feature (359)..(359): n is a, c, t, g, unknown, or other
  misc_feature (411)..(411): n is a, c, t, g, unknown, or other
  misc_feature (418)..(418): n is a, c, t, g, unknown, or other
  misc_feature (432)..(432): n is a, c, t, g, unknown, or other
  misc_feature (436)..(436): n is a, c, t, g, unknown, or other
  misc_feature (448)..(448): n is a, c, t, g, unknown, or other
cgctctagaactagtggatcccccgggctgcaggaattcgcacgagaccattacctagaacatcctaatcgaaaaatccaacgacccacactgagacgtcccctccccgctccgtcctctctcctctgccgccgagacgacgcgatggcggggtccgccgccttgccgccgctcgccgccttcgcgtcgctccttaccgcgcggcgcttcgccgccgccaggtccgcgctccggtccctgctcacgccgcgcctactggcggtgccgttcgcggacctcgccngctcgtcgctcccgcgcggnngcgcgccgcacggcgtgggtggcgntccacgacatgctcttccgcgcgtacgcgnacgcgggcgcggcgtgccgcgcggccgagcgctcgacgcccgcgtgtcccgncctcggnagctcgacccgggntcgntcacgttctcgntgctctcgctccgccggggccgggggctccggggacgccgcggccctccgggagggggggttcggttcgggccggggtcccgtctcccgttccccgggtcgggttttttaagggtttttgaaaattggggggcgggggacaaaccggcccggtggctcaaaatttgcccccccaccgggggaggctaaagaggcgggggcacccccccgggttggggggtacaggggcaaaaaggggagcggggggccccggggatttttaagatatggggaaaaagggcc

SEQ ID NO: 34014 - protein, 163 aa, Zea mays
  misc_feature: Ceres CLONE 1412333-F
  misc_feature (47)..(47): Xaa is any aa, unknown, or other
  misc_feature (54)..(54): Xaa is any aa, unknown, or other
  misc_feature (62)..(62): Xaa is any aa, unknown, or other
  misc_feature (72)..(72): Xaa is any aa, unknown, or other
  misc_feature (92)..(92): Xaa is any aa, unknown, or other
  misc_feature (98)..(98): Xaa is any aa, unknown, or other
  misc_feature (102)..(102): Xaa is any aa, unknown, or other
MAGSAALPPLAAFASLLTARRFAAARSALRSLLTPRLLAVPFADLAXSSLPRGXAPHGVGGXPRHALPRVRXRGRGVPRGRALDARVSRPRXLDPGSXTFSXLSLRRGRGLRGRRGPPGGGVRFGPGSRLPFPGSGFLRVFENWGAGDKPARWLKICPPTGGG

SEQ ID NO: 34015 - DNA, 729 bp, Zea mays
  misc_feature: Ceres CLONE 1412334-F
  misc_feature (251)..(251): n is a, c, t, g, unknown, or other
  misc_feature (263)..(263): n is a, c, t, g, unknown, or other
aagctggagctccccgcggtggcggccgctcttcaactagtggatcccccgggctgcaggtattcgcacgagaccattacctagaacatcctaatcgaaaaactcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgngccgtcgtcgcncgcggtcgcggcgcgcggcgcccgcggtctcgcggcgaccgcgttggggggttcctttttcttgtcctcccgcggtcgcttcccccccgtccttgacctggccgcgcccgggtgtccccccgccctcccgtcacttaggcggggcgcctagccgcgcttccctgccccccagccccctgtcgcgggactagtggctccgggccttcggaacgccggggatccccctagcgcttgatcgctggatcccaccggctaacccgcggcccccccccccctttttttatccgcgtacccccgcccgcccgcccaaaattgttcccccccaccgatggccagcgggacacggcgtatgcctctgacgcgatttccctccggcccttctcgcgggctgcgcttatttgtatccgtgggtcatccctctccccgcgacccgactacccccggacctcccccccgcccccgcgcc

SEQ ID NO: 34016 - DNA, 564 bp, Zea mays
  misc_feature: Ceres CLONE 1412337-F
  misc_feature: Encodes the peptide sequence at SEQ ID NO. 34017
  misc_feature (234)..(234): n is a, c, t, g, unknown, or other
  misc_feature (243)..(243): n is a, c, t, g, unknown, or other
  misc_feature (246)..(246): n is a, c, t, g, unknown, or other
  misc_feature (251)..(251): n is a, c, t, g, unknown, or other
  misc_feature (259)..(259): n is a, c, t, g, unknown, or other
  misc_feature (410)..(410): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
tggagctcaccggcggtggcggccgctctagaactagtggatcccccgggctgcaggaattcgcacgagaccattacctagaacatcctaatcgaaaaagctagcagtcgtcttgcattgtagctagtccattgctctcatcttctcttcttcctccagtcctcccccctttcccctcttcggcctctctcgctcagctcgctcttcattaagctcacgtcgttccctcccttnctccctctnctncttcntaaccggntggttcaaattcgtttcaagctagcccgggccaaaaatcggaggaatacatccccgtcacgaagggaccaacccaacccctttcccccttcaaaaaaaaaaaagggggggggccccccccccccaaaaaaaaaaaaaaaaagagggggggnaaaaaaagaaataacccccccccctccgtgggggggggaagaaaaaaaaacccccccccccccaaaaaaaaaaaaaaaaaaaannnaaaaaaaaaaaaaaaaaaaaaaaaccccgcgggtttttggtttttttttttaaaaaaaaaaaaaaaaa

SEQ ID NO: 34017 - protein, 33 aa, Zea mays
  misc_feature: Ceres CLONE 1412337-F
ELTGGGGRSRTSGSPGLQEFARDHYLEHPNRKS

SEQ ID NO: 34018 - DNA, 783 bp, Zea mays
  misc_feature: Ceres CLONE 1412340-F
  misc_feature: Encodes the peptide sequence at SEQ ID NO. 34019
  misc_feature (37)..(37): n is a, c, t, g, unknown, or other
agaagaaaaagaagagaaaaaagggtcattttgttgnaaaaacagatacctcccccccaagctggggctccccgcggtggcggccgctctagaatagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatgggccgccgcagacgcgtccgccgagaaccgcgccatcgcgcggcgcctggcctcctgcaacaccggcacccgggagcgcgcgctccgctacctcctctccgaaattttctgccggcctccgcggcgcggccttcttcccgccaccgacctccctcaaggtctgggagggcatcttctttctgcttctggcacgccaaaccaagcccgcttctaccaaaaagttccggttcgaccttcggccttcggcgggtcccccggtccgggcgggacccccctggccgaagggggggcccgccctttccctcaaaccggccaaaccgttaaacacaaagtttcccgaaaaaagggggggggggcccccaaaattggggggggtcacaacccgcccctggagaaaagtttttaaccctcccctcaaaacacgggccgggtgtcccctccaacacaagaggctctttaccacgtgttttcccaccagggaaaaaaatccctctccgcccccccccgaagggctaacccccccccacagtgtggcgggatcccg

SEQ ID NO: 34019 - protein, 31 aa, Zea mays
  misc_feature: Ceres CLONE 1412340-F
  misc_feature (12)..(12): Xaa is any aa, unknown, or other
EEKEEKKGSFCXKNRYLPPKLGLPAVAAALE

SEQ ID NO: 34020 - DNA, 713 bp, Zea mays
  misc_feature: Ceres CLONE 1412341-F
  misc_feature: Encodes the peptide sequence at SEQ ID NO. 34021
  misc_feature (520)..(520): n is a, c, t, g, unknown, or other
  misc_feature (672)..(672): n is a, c, t, g, unknown, or other
  misc_feature (695)..(695): n is a, c, t, g, unknown, or other
caaagctggagctcaccgcggtggcggccgctctagaacaagtggaacccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacatttcctgggggtgccaagtcatttgagctagttgcaaggttnctgctatggtgtgaaaatagagctttcacctgcaaatgttgtctaacctacggtgtgcctcagagcatctagaatggactgaagaagtagctgaggaaaacctgattgcacagtcagaaatgtcctccaaccaagtggttctccgtaactgnaaagattccttggcagcattggnaaacatgtgatgacctac

SEQ ID NO: 34021 - protein, 80 aa, Zea mays
  misc_feature: Ceres CLONE 1412341-F
MASVKLGSKPDAFKRQGQAWFCTTGLPSDVTVEVGDMSFHLHKFPLLSKSAFLERSIEENSDQEECIIKLNDISWGCQVI

SEQ ID NO: 34022 - DNA, 625 bp, Zea mays
  misc_feature: Ceres CLONE 1412342-F
  misc_feature: Encodes the peptide sequence at SEQ ID NO. 34023
  misc_feature (453)..(453): n is a, c, t, g, unknown, or other
  misc_feature (470)..(470): n is a, c, t, g, unknown, or other
  misc_feature (563)..(563): n is a, c, t, g, unknown, or other
ggagctccccgcggtggcggccgctctagaactagtggatcccccgggctgcaggaattcgcacgagaccattacctagaacatcctaatcaaaactgagcactgctgctgctgaaaatggcgcctgggcttgcgaactgggtcgcgctggttctgaccgtcgtccttggtctctcgtgccacgtcgcgctctcggaggatgaaacactggacaagctgcggttcgtgcgccacgcacaggacgcgcccctggtgtcgcagtacaactacatcgtgatcggcggcggcacggcggggtgcccgctggcggcgacgctgtcggagcactcgcgcgtgctgctcctggagcgcgggggcctcccgtcccgcaacatgtccgaccagcagcacttcacggacgcgctggcggacacgtcccccggcgtcgcccgcgcagcggttcgtgtccgaggnacgcgtggtgaacgcgncggcccgggtgctgggcgggggcagctgcctcaacgccgggttctacacgcgggcagcaccgactacgtgcggcgcgcccggtgggacgcccngctcgtcactccgcctaccggtgggtggagcggcgctcgggtcccgcccgccggcccccggg

SEQ ID NO: 34023 - protein, 169 aa, Zea mays
  misc_feature: Ceres CLONE 1412342-F
  misc_feature: SWISSPROT Homolog: EC 4.1.2.10 Mandelonitrile lyase
  misc_feature (118)..(118): Xaa is any aa, unknown, or other
  misc_feature (149)..(149): Xaa is any aa, unknown, or other
MAPGLANWVALVLTVVLGLSCHVALSEDETLDKLRFVRHAQDAPLVSQYNYIVIGGGTAGCPLAATLSEHSRVLLLERGGLPSRNMSDQQHFTDALADTSPGVARAAVRVRGTRGERXGPGAGRGQLPQRRVLHAGSTDYVRRARWDAXLVTPPTGGWSGARVPPAGPR

SEQ ID NO: 34024 - DNA, 698 bp, Zea mays
  misc_feature: Ceres CLONE 1412348-F
  misc_feature: Encodes the peptide sequence at SEQ ID NO. 34025
  misc_feature (442)..(442): n is a, c, t, g, unknown, or other
  misc_feature (491)..(491): n is a, c, t, g, unknown, or other
  misc_feature (648)..(648): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaaaaattccccaaaccccctcccaagtcccaaccctaggcggctagcctccttccccttcagacttcacacctccgatttctcgcgccttcgtctcccgcccaatttccagaagcttctagaaccaggtttctaaccctaccgcagaatgatgctttcttgcgcctagtagcctggggcggaggcatggacggcggcggggaggggggctcgagcggcgggaggttccctattctgcaggcgaacagggaccccgagtctaattgccaggtggacgttggcaagagcctctaggattacctgctcaagatctgctcaggtgtagactccggcgaggacggngcccactctgtcgactatgtcgaagcggagttattactcctagcatcgnttgcagtgtacagtaggaaggaggagtacttgtactcggtgctgcatcacgcgttagagatcctctcgcacatgaacaggagcaactggaaaatggctcagctcaggctaacaaaagaaccctagattatcccagtgaagagatgaatattattggntagaagatggccancggaacagaatatccctggaaccatgttatcggatg

SEQ ID NO: 34025 - protein, 35 aa, Zea mays
  misc_feature: Ceres CLONE 1412348-F
MDGGGEGGSSGGRFPILQANRDPESNCQVDVGKSL

SEQ ID NO: 34026 - DNA, 664 bp, Zea mays
  misc_feature: Ceres CLONE 1412350-F
  misc_feature: Encodes the peptide sequence at SEQ ID NO. 34027
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (429)..(429): n is a, c, t, g, unknown, or other
  misc_feature (438)..(438): n is a, c, t, g, unknown, or other
  misc_feature (532)..(532): n is a, c, t, g, unknown, or other
aagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctcccggcgtggagacccgagtcgtcgtcgctaaggagccggagccggtggaggccgagactgagactgagaccannngagccgagncgttgctgnaccgacccgagcagagcccaaggaacagagccgaagccgccgcgccggcacaaaaacggaggtcaaggaacaaaaacgaggcccgccccccggnaaaaaaaaaaggagtttgttctgccccggtcaaggttgttgacccgaaaaaacccgcaaaaaccaaaaaggggggctgggggggcaaacgagggagggagagaggccccccccggttttgggcccccccgga

SEQ ID NO: 34027 - protein, 141 aa, Zea mays
  misc_feature: Ceres CLONE 1412350-F
  misc_feature (60)..(60): Xaa is any aa, unknown, or other
  misc_feature (61)..(61): Xaa is any aa, unknown, or other
  misc_feature (64)..(64): Xaa is any aa, unknown, or other
  misc_feature (67)..(67): Xaa is any aa, unknown, or other
  misc_feature (98)..(98): Xaa is any aa, unknown, or other
MAAVEVQVPTAAPVEEAAQLAAASAVETPNEETAAPGVETRVVVAKEPEPVEAETETETXXAEXLLXRPEQSPRNRAEAAAPAQKRRSRNKNEARPPXKKKGVCSAPVKVVDPKKPAKTKKGGWGGKRGRERGPPRFWAPP

SEQ ID NO: 34028 - DNA, 705 bp, Zea mays
  misc_feature: Ceres CLONE 1412355-F
  misc_feature: Encodes the peptide sequence at SEQ ID NO. 34029
  misc_feature (80)..(80): n is a, c, t, g, unknown, or other
  misc_feature (84)..(84): n is a, c, t, g, unknown, or other
  misc_feature (91)..(91): n is a, c, t, g, unknown, or other
  misc_feature (92)..(92): n is a, c, t, g, unknown, or other
  misc_feature (94)..(94): n is a, c, t, g, unknown, or other
  misc_feature (351)..(351): n is a, c, t, g, unknown, or other
  misc_feature (365)..(365): n is a, c, t, g, unknown, or other
  misc_feature (366)..(366): n is a, c, t, g, unknown, or other
  misc_feature (410)..(410): n is a, c, t, g, unknown, or other
  misc_feature (454)..(454): n is a, c, t, g, unknown, or other
  misc_feature (466)..(466): n is a, c, t, g, unknown, or other
gctctagaactagtggatcccccgggctgcaggaattcgcacgagaccattacctagaacatcctaatcgaagtatctgnaccncaaccgnntncacacgacaccaccaccagccctccccttcatcaattggagcacggcgcccgttcattcccctcttctccgctgcttgcctccggctccccaattccacgagatctccaattccaccgcgtcgtctctgcatccggaccccataccccgatcgatccctaagggccatggttttctccgccgccgcgtcgcctctagtagccaccgctgctgactctgcttcctcctgcgtcgcccacctccgctgctgctgtcgcngtagttgctgccgnntgtgaagacgcgtagctctttagggtcgcgatttctcgctgatncggtcgaagatgggtaagctatggatttttcgggggcaaatcgncggaccctccgntcgggtccccttccagggccacccccaggcccaccttcaaaggcacggggaaaccccccccttgccccttgttcaaaacccgggagaacaaacaccaacccgtttggggcccaaaagcccccccagaagaggttaaaaaagggggggaaaaaaaattttcccccccgggggatccccttttttaaaacccccccgtgtgcccaaaaaaggggggggggggaaaacacactttcttcccc

SEQ ID NO: 34029 - protein, 35 aa, Zea mays
  misc_feature: Ceres CLONE 1412355-F
  misc_feature (31)..(31): Xaa is any aa, unknown, or other
MVFSAAASPLVATAADSASSCVAHLRCCCRXSCCR

SEQ ID NO: 34030 - DNA, 702 bp, Zea mays
  misc_feature: Ceres CLONE 1412356-F
  misc_feature: Translation starting site: 437
  misc_feature (523)..(523): n is a, c, t, g, unknown, or other
aaagctggagctccccgcggtggcggccgctctagaactagtggatcccccgggctgcaggaattcgcacgagaccattacctagaacatcctaatcgaaaaaacgacgcgattggcgattccatttctaccccgagacctccagccgtccgcccctgaaccctcagccttctccgtcccgcctcggcactcgacggccgccggcacacaccgcgcagtctcgagacaggtaacccgctcccctctccgctgaactcctctcccaacaaggggccagcctcacccccaacgcccatctaagccaagtgcacggtgctgctagatcccgatctcgttctgccaaccgccgagggagggttgcgctcgccggatcccgcccgagtcacgtgcggctttgattcgctgcacctgtcgtgcaggaaccggaggaaacgagatggaggatgactcgccgctgacgaagacgatgaagggtgcggtgacaggactcgccgcggggaccatctgggggcaccgtcgtcgncacctggtacgacgtgcccccgtgtgggagggcccacgccgcggttcctgggctttatcgggaagcttaaaaaggggcggaacccaacggggcccccttccccaccatgggggggccctaaattcggggtcaaaaaaacttggtggaaaacccggccaaaaaaccggatttcctcaacg

SEQ ID NO: 34031 - DNA, 724 bp, Zea mays
  misc_feature: Ceres CLONE 1412357-F
  misc_feature: Encodes the peptide sequence at SEQ ID NO. 34032
aagctggagctccccgcggtggcggccgctctacaactagtggatcccccgggctgcaggaattcgcacgagaccattacctagaacatcctaatcgcaaagtcgtcgtccactcgttcgtcgctgctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggtccgccccgggggtggggacgcgggcccggggttctcgctggccatcgagggcgtgctgggcgcgtgcggcatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggaggcatccccttgttgatgcaccagttgttactaggattcggagatgtttagaatgaaggactgaatttcatggcgatctgttaaatttaaaaaagaattgttctccataattggccagcttgcattacacccatata

SEQ ID NO: 34032 - protein, 107 aa, Zea mays
  misc_feature: Ceres CLONE 1412357-F
  misc_feature: SWISSPROT Homolog: EC 2.7.11.1 Non-specific serine/threonine protein kinase
MEWDSDSDGGDDEEEEEVRPGGGDAGPGFSLAIEGVLGACGMVVSDALEPDFPIIYVNRGFESSTGYSAEEVLGRNCRFLQCRGPFAQRRHPLVDAPVVTRIRRCLE

SEQ ID NO: 34033 - DNA, 648 bp, Zea mays
  misc_feature: Ceres CLONE 1412358-F
  misc_feature: Encodes the peptide sequence at SEQ ID NO. 34034
  misc_feature (187)..(187): n is a, c, t, g, unknown, or other
  misc_feature (195)..(195): n is a, c, t, g, unknown, or other
  misc_feature (196)..(196): n is a, c, t, g, unknown, or other
  misc_feature (505)..(505): n is a, c, t, g, unknown, or other
  misc_feature (587)..(587): n is a, c, t, g, unknown, or other
caagctggagctccccgcggtggcggccgctctagtactagtggatcccccgggctgcaggaattcgcacgagaccattacctagaacatcctaatcaaaaacctcctctgcctgccgcttctcctgctgcgggcggtcacggctgcaagtactagaggaggacatccgcttccattactgcgcctngcggaggnnatcggaggaacccaggtagcgggaaggctttccaaattttccgggcggggggggaaaaaaaaaatttcccccgcaaaggggtctcgggaaagggcgcccgggggcacccccgccccggcccctccccggggtggccctccccggggggggagggggcccccccttcccgggggggggggacccccccacgctgcgccccccccctccttggttttttttcgccccccaacaaaaaccgccctctccccgcccaacgggggttttttcttttttaatcgaccttccctttcacaccccgcaccgcgcctnttgtcgttctaacaacaacgtgctttcctatccccctgcccgttccccccggcccctaatttccttagagccgcacccgcgnacggagccaccaacaccccactagccgtaccgttgaccgaatcacttcctcgtccgtaggc

SEQ ID NO: 34034 - protein, 51 aa, Zea mays
  misc_feature: Ceres CLONE 1412358-F
QAGAPRGGGRSSTSGSPGLQEFARDHYLEHPNQKPPLPAASPAAGGHGCKY

SEQ ID NO: 34035 - DNA, 655 bp, Zea mays
  misc_feature: Ceres CLONE 1412359-F
  misc_feature: Encodes the peptide sequence at SEQ ID NO. 34036
tggagctccccgcggtggcggccgctctagaactagtggatcccccgggctgcaggaattcgcacgagaccattacctagaacatcctaatcgaaaaagcggagcactgtgcaggcgaccgcggcgcgctatcacttacggggggatacggcggcatcgtccccctcggcccctcctccatccctggtgcggcggcgccagcactgcaggtgttgaatgctgatttgttgtggctgattaatcgggttgatcgtcgattaatcgtgattagtcggctgatcgcccttctggcgatcagaaacgatcaggcaatctgaaaacattggccgacaaacctccagagcgactcctgcgagccgtgaccaccatagctaaatcaacgcaccagaagctttcacggagctgtctcgtccacgagtgatccagctgactcctattccctgcgtcaatggcgagctctggcaatgaagggcgtgtggtggtggaccttggctccgcgacggattcgaaggctgctgacgaggaggtgcacgccacgcctctccacgagattgagtccctttgcatgcgctgcggcgagaacgggatcacgaggcttttgctgacgttgatcccgcacttccgggaggtggttctgatggacttcgagtgccca

SEQ ID NO: 34036 - protein, 69 aa, Zea mays
  misc_feature: Ceres CLONE 1412359-F
  misc_feature: The sequence is a functional homolog of SEQ ID NO 48 in the 10/225,066 US patent application
  misc_feature: The sequence is a functional homolog of SEQ ID NO 2316 in the 10/374,780 US patent application
  misc_feature: The sequence is a functional homolog of SEQ ID NO 240 in the 10/412,699 US patent application
  misc_feature: The sequence is a functional homolog of SEQ ID NO 88 in the 10/666,642 US patent application
MASSGNEGRVVVDLGSATDSKAADEEVHATPLHEIESLCMRCGENGITRLLLTLIPHFREVVLMDFECP

SEQ ID NO: 34037 - DNA, 548 bp, Zea mays
  misc_feature: Ceres CLONE 1412361-F
  misc_feature (397)..(397): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatattgtaccaataatggcagccaaaatattttgcctcattatgctccttggtctttctgcaagtgctgctacggcgagcattttcccgcaatgctcacaagctcctatagcttcccttcttcccccatacctctcaccagcgatgtcttcagtatgtgaaaatccaattcttctaccctacaggatccaacaggcaatcgcagcaggcatcttaccttttatcacccttgttcctccaacaaatcatcagnccctattaacaaacagtttacccttttgggggcattttaattgggcaccaaaaaaatttccgggggaaaaaaaaaattaaaaaaaaaaattcggggggtttaaaaaaaaaaccttgtgggtgggcccaacaccccccaaaaaaaaaaaggc

SEQ ID NO: 34038 - DNA, 754 bp, Zea mays
  misc_feature: Ceres CLONE 1412362-F
  misc_feature: Encodes the peptide sequence at SEQ ID NO. 34039
  misc_feature (41)..(41): n is a, c, t, g, unknown, or other
  misc_feature (43)..(43): n is a, c, t, g, unknown, or other
ggggggggggggggggggggggcaaagggggaggaaaacananaagataaaaaggaaagctggcgctccccgcggtggcggccgctctagaactagtggatcccccgggctgcaggaattcgcacgagaccattacctagaacatcctaatcgaaaaaattccccattcaccaatccccagtattgtagtaggggggaaaaacgagagaaaagaaacagcagtagcggaggcaagacgaaatggtggccgccgtcgcgtcgccttcgtcggcggcaccctccgccggccgtccccatccgacatacaaggagatgatcatgcaggcgctgacggagctgcgggacccgagcgggtcgagccgcagcggcatcgccagctacatcgccgaccacttctccggcctccactcgcgccacgatgccctcctctcccgtcatctccgcaggctcaagtcccatgggccaacttcgcccccggctctggtaaattactttcgtctcccaccgccggttcaggggaaggggtggaggttccaaacattccgggccaaacccccaaaccctggttccggggcaaaaaaaccgtgggcggggggggcgggccccccaagggcaccgcgaattcccaacccctttcccgctttcggacccccgggggttttctcggggggccaaacggggggggggtggggctcgcccctcccgggggggcggggtgggggggctccggcccgcccgggggggggctctcccc

SEQ ID NO: 34039 - protein, 147 aa, Zea mays
  misc_feature: Ceres CLONE 1412362-F
  misc_feature (1)..(65): Pfam Name: Linker_histone Pfam Description: linker histone H1 and H5 family
MIMQALTELRDPSGSSRSGIASYIADHFSGLHSRHDALLSRHLRRLKSHGPTSPPALVNYFRLPPPVQGKGWRFQTFRAKPPNPGSGAKKPWAGGAGPPRAPRIPNPFPAFGPPGVFSGGQTGGGWGSPLPGGRGGGAPARPGGGSP

SEQ ID NO: 34040 - DNA, 765 bp, Zea mays
  misc_feature: Ceres CLONE 1412366-F
  misc_feature: Encodes the peptide sequence at SEQ ID NO. 34041
  misc_feature (248)..(248): n is a, c, t, g, unknown, or other
  misc_feature (317)..(317): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggngcgggggcgatctgatgcgggcgcggcggtgatggcagcgccatccggcggtgggggcggcggtgcggnggagggctcctcctcggccgccgcagctgcgacgatcggggtccacggggtgggaccaagttgcagaggcgatgtggcagatgaatttggaaagaagcatggaactggggccatacccagagcgtgttggtgagccagactgtagctattacatgaggactgccatgggcaggtttggaatgacctgtaaaatttatcacccancaaacaaaaagctggttgttgctgctgcaaaaatgaagggaaaatatcctcaaagaatggggcaagctgaatgcaaaaactatcggaagacgggaccgtgaaaatttgggacaacttggaaagttccctcatcccccaaaaaagggtggatgggcaaccccaggcccgggggaggaaaggggctccccccccccccccaaaaagaaaaaaaagggggtttttttttttaaaaacggggcgggga

SEQ ID NO: 34041 - protein, 77 aa, Zea mays
  misc_feature: Ceres CLONE 1412366-F
  misc_feature (45)..(45): Xaa is any aa, unknown, or other
MWQMNLERSMELGPYPERVGEPDCSYYMRTAMGRFGMTCKIYHPXNKKLVVAAAKMKGKYPQRMGQAECKNYRKTGP

SEQ ID NO: 34042 - DNA, 649 bp, Zea mays
  misc_feature: Ceres CLONE 1412367-F
  misc_feature: Encodes the peptide sequence at SEQ ID NO. 34043
tccccgcggtggcggccgctctagaactagtggatcccccgggctgcaggaattcgcacgagaccattacctagaacatcctaatcgaaaaaccaaaggtatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgacctttcacttcgtcaagaacggcaagacggtcgcgaccatcgtgggtgcccagaaagacgagctcctggccctgatcgagaagcatgcccgcgctgcgcctgcgactgcgtcttgctaaatgaaatcagatcagtccgccgccctcaataaaggcccagcacgtagggctggaaatgttggccgtatcagttctgggttttggcctttgggggggaatttggggaacaaaaaaaatgt

SEQ ID NO: 34043 - protein, 122 aa, Zea mays
  misc_feature: Ceres CLONE 1412367-F
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVDVDEVKEVTAAYEVEAMPTFHFVKNGKTVATIVGAQKDELLALIEKHARAAPATASC

SEQ ID NO: 34044 - DNA, 736 bp, Zea mays
  misc_feature: Ceres CLONE 1412374-F
  misc_feature: Encodes the peptide sequence at SEQ ID NO. 34045
aagctggagctccccgcggtggcggccgctctagaactagtggatcccccgggctgcaggaattcgcacgagaccattacctagaacatcctaatcaaaaataacctccaccatcaccgtgccggaccgcacccgcgctaggggaacagctctttccttccgctgggccgcgcctccgtccgacccggtgtcctcggcgagctccgcctccgtcgggcgcgacgctggcgggagaggactgcctctatggccgcctcaagtcggtccagcgccatgtggagtgtcgtcgagatcctccgaggagtacgatactgacgaacggcaagaatgtcgagcgcgaactcctccgagcgcttgatgaggctgagggtgtccactccgtaccgctcgtcatcgctcagtttatggagatggtcgaccgcaacgacgctatcgtggggtctattacgggcagcagctactatgtgcgtctcctgcgcgccgtacatcgggagccgctcaagccgtcagcatctgacgtgttggctccaccctgccgcgccttgagcaatatgcctgcgtgccgagccccacccgcgcgcctcccgtgctgccgccgctcggatgcctcccccggcgcctaaccatcacatacgaggaggggcgttcgccttcttaataaataccccgggacggttcggcgcacccgtggccgcttcttgcccttccggccgccaacctgtttcggtccgccccc

SEQ ID NO: 34045 - protein, 72 aa, Zea mays
  misc_feature: Ceres CLONE 1412374-F
MEMVDRNDAIVGSITGSSYYVRLLRAVHREPLKPSASDVLAPPCRALSNMPACRAPPARLPCCRRSDASPGA

SEQ ID NO: 34046 - DNA, 724 bp, Zea mays
  misc_feature: Ceres CLONE 1412379-F
  misc_feature (605)..(605): n is a, c, t, g, unknown, or other
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaaccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcggaaaggccggccagccgcccacaccccatccggccagccaggcggaaacgaccgtaagagggaagccgcagccggccgctgactccgatcccacctctagtcaaccccaggcagaccgatcctcttcgtctgaccacgacgtccatctcgcacgcctacttccactcaaccacataagtcttttctgccaggcctaacctttcccctgcgccgcctctactggttttgcacagtgccgtgacgtgcgaagacgtggagatccaacgaaaattagatttatttcttccttcttcggtccaacagttcctcagcttgcgtaagatccgtctggnttgtccgccctccattgnactaccccaggtgcggcgcatccaccaggtggaagatatctgcgtagtcaaaacatagataagagtggactgctattagttttccatagatggatccttgg

SEQ ID NO: 34047 - DNA, 708 bp, Zea mays
  misc_feature: Ceres CLONE 1412381-F
aagctggagctccccgcggtggcggccgctctagaactagtggatcccccgggctgcaggaattcgcacgagaccattacctagaacatcctaatcgaaaaatcatctcggcggctatcttgtgcctattccccgcctatttgcgccatccgcgaccgtgggctccgtcgggtcttgtgtatcttgcggtgcgaggcctcatcacaactctggcctctgcttgattggattctcggcggtcggggcctccagcgtcgcgatctttcctgccggcttcgtcaaccggtggacaacctgggcggtcggacccggcgggtcttcacctccgtgctgcctgccaccggcgctgtactcctgttttgatcacgattttagctgtctgcggacacctgctttaccgattcttggattggtggcttcttgggggatagaatgcgagtcctgcttcgtctcttgtgctccttgtgttctgtagcacgccgaatcctcatctccagtgaaggtgtgcgtgtgctcttgcatctgagcctcccgtaatcgctcccggaaagctacttttggtcgctgcgccgatgtagtctaggaccagccagatggtctgatggaaggagaagctgatcagcttcgacaggttggtaacaaccatacttatgtgtgcgcagacgagattgatcttacgagtctcgacatccatctggacaaccagat

SEQ ID NO: 34048 - DNA, 643 bp, Zea mays
  misc_feature: Ceres CLONE 1412382-F
  misc_feature: Encodes the peptide sequence at SEQ ID NO. 34049
  misc_feature (628)..(628): n is a, c, t, g, unknown, or other
  misc_feature (629)..(629): n is a, c, t, g, unknown, or other
gctctagaactagtggatcccccgggctgcaggaattcgcacgagaccattacctagaacatcctaaacaaaaagcctcccgagaccccacgcaccagtctccttcccctcccaaccctccgaatagaagaaagctagctagaccatgacgctcgacgatcccgagactaatggcgctgctaggcgctccggtacatgcgccacgcgcgggagcacgagaatatgcacgtgctcccccgggaaaatccgctcccgagcgggctgctcccgctgcagtacatcatccagtgcgcctacgcgtaggacaggtgataagtgtgactccagcaatgccggaaggcgaaccactacttcgtcaaggccgaccaccacgagtcctactccgccgaggtgtcagcggtggccgacaagcacaggatcaacaagatcaagggggtcgaggccaagcagatcgtgatgtacgacaacatccagaatatctgccgccacaaggcgctcacgtacaatctccactgcaatgccaacgacgctgtggcacgaaacttccccgacgaggtacattacgcctatgaatcctggccgaccgcaaccagaggcgtcagtcccatacaccaggatgagagcagtnngaatttcccaaaac

SEQ ID NO: 34049 - protein, 35 aa, Zea mays
  misc_feature: Ceres CLONE 1412382-F
MRHAREHENMHVLPRENPLPSGLLPLQYIIQCAYA

SEQ ID NO: 34050 - DNA, 656 bp, Zea mays
  misc_feature: Ceres CLONE 1412383-F
  misc_feature: Encodes the peptide sequence at SEQ ID NO. 34051
tccccgcggtggcggccgctctagaactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggccgacgccgacccggctcagcggaagatcttcgtac

SEQ ID NO: 34051 - protein, 129 aa, Zea mays
  misc_feature: Ceres CLONE 1412383-F
MGKKRKLEPKSAAGFTPVKASPTTRSATAKAAGLSEVLAPVEATMEKLPQGAGGEDVEEIEEVEVEEEVEVEEEEEGESDQASIQALLDSFPKDQLVELLRDAAIAHGDVLTTIRRVADADPAQRKIFV

SEQ ID NO: 34052 - DNA, 681 bp, Zea mays
  misc_feature: Ceres CLONE 1412385-F
  misc_feature: SWISSPROT Homolog: EC 3.1.3.16 Phosphoprotein phosphatase
  misc_feature (443)..(443): n is a, c, t, g, unknown, or other
  misc_feature (447)..(447): n is a, c, t, g, unknown, or other
  misc_feature (448)..(448): n is a, c, t, g, unknown, or other
  misc_feature (464)..(464): n is a, c, t, g, unknown, or other
  misc_feature (467)..(467): n is a, c, t, g, unknown, or other
  misc_feature (531)..(531): n is a, c, t, g, unknown, or other
  misc_feature (532)..(532): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (579)..(579): n is a, c, t, g, unknown, or other
aagctggagctccccgcggtggcggccgctctagaactagtggatcccccgggctgcaggaattcgcacgagaccattacctagaacatcctaatcgaaaaatcaaacccccggacatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgcttctcgccgacgcgcagaagaccgtcgagctcaagcctgactgggccaagggctactcccgcctcggcgcggcgactngggnncctttcggcgacgccnccngcgccgtcgccgcatacgagaagggccttgcgctcgaccccagcaacgaagttctcaaggcggnngctcgaggacgccaagaaggccgcgcgccgcccnnnnnttttggggncccgtcgggccccgacgctttcggccagatgttccagggccccgaactgtggagcaagatcgcgtccgaccccaccacacgcgcctaccttaacgagcccga

SEQ ID NO: 34053 - DNA, 572 bp, Zea mays
  misc_feature: Ceres CLONE 1412389-F
  misc_feature (215)..(215): n is a, c, t, g, unknown, or other
  misc_feature (345)..(345): n is a, c, t, g, unknown, or other
tggagctccccgcggtggcggccgctctagaactagtggatcccccgggctgcaggaattcgcacgagaccattacctagaacatcctaatcgaaaacgttcactcctctgcgtccggtcttcttcgtcccctccgtcgccttcacacctgcttgccatttgcgatttcaccgtcccgtcccgtggcgcaacgaccgccgccttccggccacccnggtcgcgggctcccccggattcgcgcccaccgcgcctccggatcgtctcggagatctgccgctgagggagtgcatatatctgagctgtgctcctcaagtgtcgagaagtcctgtttattcgtttttgtgncggactgcagtgaatggaggagttgaggagggaacaggaaacccggaaagctgccacaggggctccgcctgctctccagccgcatgatccccggaaaggcaagaacataactttgggcacggacaaaaaatgggccaggttcacggaaagggggcttccccaatgagaaaagggaagaaaggggttatagaaaaaaacccggcccccccacggggaaaaagggaaaa

SEQ ID NO: 34054 - DNA, 670 bp, Zea mays
  misc_feature: Ceres CLONE 1412392-F
  misc_feature: Encodes the peptide sequence at SEQ ID NO. 34055
  misc_feature (563)..(563): n is a, c, t, g, unknown, or other
aagctggagctccccgcggtggcggccgctctagaactagtggatcccccgggctgcaggaattcgcacgagaccattacctagaacatcctaatcgaaaagttctgttctgttctgtcctgtccatcacaattcacgcgacgacgacccggcctgaggagcagatctttcttgacctagccagctcgttcttggcgcactagctagccagccagctagtaactatcctcgctcctccccaccgtcctcagtgctagactattcgtccgatgggcggcgtccaactcgacgacctctccgaattggccgtgctccggccgatccagacagcggcagcggctcggccgccgggcgacgacgccgaagacggcccggacgccgccgacacgggctgcgtcacgccaacggcctcgagctcccggctgatgccgatgccgcgcctggacggcggctgcggcgccctggacagtaccgacgccgccgccgccgcctgcgacacgccggcggcgtcaccttgcctgctgcggccggacacggtgtgccctccggcgccctgaaacccnggccaggccggccgaaccgccgtcgacatacagaaggaagtgctgctgctgcacccgcagcttcttccacgtgccggacaacttctaccgcgcagtacgtgacgcac

SEQ ID NO: 34055 - protein, 95 aa, Zea mays
  misc_feature: Ceres CLONE 1412392-F
MGGVQLDDLSELAVLRPIQTAAAARPPGDDAEDGPDAADTGCVTPTASSSRLMPMPRLDGGCGALDSTDAAAAACDTPAASPCLLRPDTVCPPAP

SEQ ID NO: 34056 - DNA, 717 bp, Zea mays
  misc_feature: Ceres CLONE 1412394-F
  misc_feature (225)..(225): n is a, c, t, g, unknown, or other
  misc_feature (689)..(689): n is a, c, t, g, unknown, or other
  misc_feature (691)..(691): n is a, c, t, g, unknown, or other
aagctggagctccccgcggtggcggccgctctagaactagtggatcccccgggctgcaggaattcgcacgagaccattacctacaacatcctaatcgaaaaaatgcctcacccgtaagccgcgtcgcagctccaccgcgcgtcgcaatggccggccccggcgcatccgtagcggtgctggcggtcctggctcgccgccgccgccgccgccgtcttcacacgctgngctcgtcgcggagccgccgccgagcgatgggtcagggctgctagggttcctgactcgtaccccgcacgaggggcgggctcgggtgaaacctctccatcccgccatgccgagtgccgccctcttcacgcgcgacgacggcagcgccgctttacttccatgagggccgacggggacatccccatttcaccaaggccggtggctcctaaaaaattccccgggggttattggtttgccgagtctatccccggttccccggcggtctgtttctttttttccccaaccgaagatttggtttttgggccccccagccgcttttttaaaaaattccagctttttgtccaaagcggcccaccttggggatttcgggggtttcccccccctccaaccccgggaacttttcccaaaaactctctggagtatatattgccttgagccccccctttttacgggaaccttcctggcgngngtttgggtttgcgcccccacaattat

SEQ ID NO: 34057 - DNA, 723 bp, Zea mays
  misc_feature: Ceres CLONE 1412395-F
  misc_feature: Encodes the peptide sequence at SEQ ID NO. 34058
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (22)..(22): n is a, c, t, g, unknown, or other
  misc_feature (394)..(394): n is a, c, t, g, unknown, or other
ggggnnggggnnnnnaaaaaangaaaaaagagaggggggaagaaaacgatcaaacactaggtggagctccccgcggtggcggccgctctagaatagtggatcccccgggctgcaggaattcgcacgagaccattacctagaacatcctaatcaaaaaacatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacnaggagggcatgcgcgcctgcttcgacgccgctaagacatggatggcgattcctgctccaaagcgaggagagatcgttaggcaaatcggggatgcactgagaggaaagctccatcaccttggcaggcttggtggcccttgaaaagggggaaaattcttcctggagggaatcgggggggttccagggaaatcattgggaagggggggattatgggtggggggaaaaaagccccccaacctaaaagggggtcccctttaaaacccttctgggaaacggcccaaaacccttatggatttttggggggggggggggaaacccccccctggaggg

SEQ ID NO: 34058 - protein, 105 aa, Zea mays
  misc_feature: Ceres CLONE 1412395-F
  misc_feature: SWISSPROT Homolog: EC 1.2.1.3 Aldehyde dehydrogenase (NAD(+))
  misc_feature (60)..(60): Xaa is any aa, unknown, or other
MGAFAKEEHQFLAELGLAQRNPGAFACGAWGGSGPTVTSTSPTNNQVIAEVVEASVHDYXEGMRACFDAAKTWMAIPAPKRGEIVRQIGDALRGKLHHLGRLGGP

SEQ ID NO: 34059 - DNA, 694 bp, Zea mays
  misc_feature: Ceres CLONE 1412397-F
  misc_feature: Encodes the peptide sequence at SEQ ID NO. 34060
  misc_feature (513)..(513): n is a, c, t, g, unknown, or other
  misc_feature (541)..(541): n is a, c, t, g, unknown, or other
  misc_feature (597)..(597): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcgactgctgctacggaggcgaccctcgccccgatttttggcttccatcccactgaggaggagctcggctcctactagctccgccggcgcgtcctcggccgccgcctccgcgtcgacggcatcgccgagatcgacctctaccgcctcgagccctgggacctcccctccctctcccgcatccgcagccgcgacgcccagtggtacttcttcgcccgtctcgaccgcaaggtcgccggcggtggcgccgggggccgggggggtcccggcgacaggacgaaacgggctacgccgaggtggtactggaagaccacgtgcaaggatcgnctggtgcacccccgtgggaagtgccgtnggcttgaggagactcttgggttttccgccgggtggtctgctatttgtgagaggacnaatggaccgtgtgatggttctgtctcttcnnnggcatacggaccccacgcactggatgtggattgctaaattattaaaaactttgtggtttggacca

SEQ ID NO: 34060 - protein, 40 aa, Zea mays
  misc_feature: Ceres CLONE 1412397-F
MSLSPLDSSSPPAAAATAATEATLAPIFGFHPTEEELGSY

SEQ ID NO: 34061 - DNA, 670 bp, Zea mays
  misc_feature: Ceres CLONE 1412398-F
  misc_feature: Encodes the peptide sequence at SEQ ID NO. 34062
  misc_feature (510)..(510): n is a, c, t, g, unknown, or other
  misc_feature (517)..(517): n is a, c, t, g, unknown, or other
  misc_feature (518)..(518): n is a, c, t, g, unknown, or other
  misc_feature (597)..(597): n is a, c, t, g, unknown, or other
tggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaagggtgtggggggaggccacctacgacctcgccaccgtgctcngcttccnntcgcgtctcgccttcaccatctccgtctacatcatgtccagggccagggcccgtgtacctcatcgacttcgcatgctancagcccgccgacgagctcaaggtgtccaggccgagttcatcgacctggcgcgcaggtccgggcaggtcgacga

SEQ ID NO: 34062 - protein, 156 aa, Zea mays
  misc_feature: Ceres CLONE 1412398-F
  misc_feature: SWISSPROT Homolog: EC 2.3.1.119 Icosanoyl-CoA synthase
  misc_feature (103)..(103): Xaa is any aa, unknown, or other
  misc_feature (106)..(106): Xaa is any aa, unknown, or other
  misc_feature (132)..(132): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRKGVGGGHLRPRHRAXLPXASRLHHLRLHHVQGQGPCTSSTSHAXSPPTSSRCPGRVHRPGAQVRAGRR

SEQ ID NO: 34063 - DNA, 649 bp, Zea mays
  misc_feature: Ceres CLONE 1412399-F
  misc_feature: Encodes the peptide sequence at SEQ ID NO. 34064
  misc_feature (319)..(319): n is a, c, t, g, unknown, or other
tggagctccccgcggtggcggccgctctagaactagtggatcccccgggctgcaggaattcgcacgagaccattacctagaacatcctaatcgaaaaaaggaaaaaaaaggatggctctccggcgcaacgccggatccctcgcgctccgcgccgccgcctacctccgccgccaccgtccccatcctcctcccccactggccctcgccgcccccgctcccactcccatacgctccccgctggccccgcctttccggcacttcgctgctccgcctggtactcagaccaataggaagcgaggcaaggaggaggacgatgccngcgcgggcccgcgcatgaacaacgccatcgccgctcccttcgtcaggctcgtcatggatgaaggccacaacattctcccccggcatgaagccttgcagcttgcgatcaggatggacatggacttggttgaggtcgataggaaatcagacccacctgtatgcaaaatcatggattttcacagagagaaagtatagaaagaaaccagggagaagaacgcttggaaaccaagtctgctattgtcttacgtggtggggagaaacaagaagtgcgattaaggggaagactgaactaaaagatttgatgggtgaagccgaatggtataacagataa

SEQ ID NO: 34064 - protein, 133 aa, Zea mays
  misc_feature: Ceres CLONE 1412399-F
  misc_feature (70)..(132): Pfam Name: IF3_N Pfam Description: Translation initiation factor IF-3, N-terminal domain
  misc_feature (70)..(70): Xaa is any aa, unknown, or other
MALRRNAGSLALRAAAYLRRHRPHPPPPLALAAPAPTPIRSPLAPPFRHFAAPPGTQTNRKRGKEEDDAXAGPRMNNAIAAPFVRLVMDEGHNILPRHEALQLAIRMDMDLVEVDRKSDPPVCKIMDFHREKV

SEQ ID NO: 34065 - DNA, 807 bp, Zea mays
  misc_feature: Ceres CLONE 1412402-F
  misc_feature: Encodes the peptide sequence at SEQ ID NO. 34066
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
ccccnnnnnnnnnnnnnnnnnnnnnnnnnggggcgcggcccnnnggccggccccccccaaagtggagctccccgcggtggcggccgctctagtaactagtggatcccccgggctgcaggaattcgcacgagaccattacctagaacatcctaatcgaaaagtcccacccgcttcggcctctccctcctcctcgctcgctcgatcgctcccacgtcctcgcctccctccacaaaccaccaccaccatccaggatcgcagcgcggcgcgcgagagaggggcgagcaggtcgcgcaagatgagggagatcctgcacatccagggcggccagtgcggcaaccagatcggcgccaagctctgggaggtgatctgcggggagcactgcgttgactccacgggcccgctactcggggagctcctcgcagcagctcgagctcgaggggatcaacggctactaccacgaggctgggagctgcccccgctaagcggccccgcgcccgtggctcatgggaacctgggagccccggaacccatgtgaatcccaatccgccgccggccccccttttcgaggggcaaattttccggcccccgacaaacttgtggtcttacgggcccagtcccgggcgcccggcgaaacaaaattgggggccaaggggcccacttacccccggaggggggccccaggtcaaaccgacctccggggcctttggaagcccgcgccgccaagggagggtccgaagaaactgccgacctggccctcccacgggcttccacaagtaatcgcccacctcccccgggactgggcggccc

SEQ ID NO: 34066 - protein, 79 aa, Zea mays
  misc_feature: Ceres CLONE 1412402-F
MREILHIQGGQCGNQIGAKLWEVICGEHCVDSTGPLLGELLAAARARGDQRLLPRGWELPPLSGPAPVAHGNLGAPEPM

SEQ ID NO: 34067 - DNA, 718 bp, Zea mays
  misc_feature: Ceres CLONE 1412406-F
  misc_feature: Encodes the peptide sequence at SEQ ID NO. 34068
aaagctggagctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagacggagccttgaggtcaggatttctggtttgcctggtctgtctaaatctgttggatctgtgagtgacctgcgcgacagacctgtagtagttgatcaaagcaggtgggttggtcttcctcctgaattgcttcgagatgtaatgagaaggcttgaggaaggtgagagcaattggccatcccggaaaaatgttgttgcctgtgcagccgtctgtggaacatggagagagatatgcaag

SEQ ID NO: 34068 - protein, 38 aa, Zea mays
  misc_feature: Ceres CLONE 1412406-F
MSLSERRQIPLEFGAQSFESRGQNFLLISLAEKRLLCV

SEQ ID NO: 34069 - DNA, 644 bp, Zea mays
  misc_feature: Ceres CLONE 1412407-F
  misc_feature: Encodes the peptide sequence at SEQ ID NO. 34070
tggagctccccgcggtggcggccgctctagaactagtggatcccccgggctgcaggaattcgcacgagaccattacctagaacatcctaatcgaaaaaaaggcctcgcggcacgggagcggcctgcgctccctctctctggattaggcaaagcatcctcctgtttggatcggcatggagaagacgacgacgacggcgcagccggtctgcgcggaggagtcgctggcgctgctcaactgcgtcgcctcggtcccctacgaccgggataggtgcctcgccctcgtcgacgccctccgtggatgcatcgtgcgcaagagggtgaagaagttctcgctggctgaccaagctgccacacgaccaccgaagctctgaagagcgatacgaagtcctgagcattctgcaaagaaaactctcttatggtttcgcaactgtatcatctgatttgggcgcggatgatgagtactctatgcctgttaatgtagcgttagaattgggactatgaaacgctggcacgaaacccccaatctggtggactgaaaacggtatccaatgtgcacccaattggtacaaaaagaaaaaaaaaaatttcggatacgtccaaccccagggggggccccggacctggaaaatccctcccaaatttcc

SEQ ID NO: 34070 - protein, 65 aa, Zea mays
  misc_feature: Ceres CLONE 1412407-F
MEKTTTTAQPVCAEESLALLNCVASVPYDRDRCLALVDALRGCIVRKRVKKFSLADQAATRPPKL

SEQ ID NO: 34071 - DNA, 716 bp, Zea mays
  misc_feature: Ceres CLONE 1412408-F
  misc_feature: Translation starting site: 482
  misc_feature: SWISSPROT Homolog: EC 1.1.1.40 Malate dehydrogenase (oxaloacetate-decarboxylating) (NADP(+))
  misc_feature: SWISSPROT Homolog: EC 1.1.1.39 Malate dehydrogenase (decarboxylating)
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaaacatccgtcttcctcctgtaaccagatctgaacccgaggagattgacacaaacgctcgatcgctcgttcgttgtccggtcattgtcttcgtcggcgcctagggaccctgagaggacaggcgggcgatatggcgcctggtgctcctgaggacgtgtactcttaggaccgcgctaccgaggagcaactgatcacgacgtgggccttctccgtcgcaagcgactacaccctgctgcgcgacccgcgggacaacaagggcctggacttctcggaggcggagcgcgaagcgcactacctccggagcctgctgccgccggcgctggcgtcacaggagctgtgggataacaagctcatgcataacctgcgctcgacacgagcagccgatgcaccgctacatcgccatgaaggacctgcataagcgcagcgataggctcgtctacaagctcctcattgacgacgtcgaggatctgcatctgcgtcgaactacacgcccaccgtcatcagaggcatgccacaagtacgtcagcatctacgtacgcccgggaggggtctgtacatcagcctacagggacgagggtacnaaaacctctaggtgggtcagtaaatggagcgtagagg

SEQ ID NO: 34072 - DNA, 517 bp, Zea mays
  misc_feature: Ceres CLONE 1412410-F
  misc_feature: Encodes the peptide sequence at SEQ ID NO. 34073
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (305)..(305): n is a, c, t, g, unknown, or other
  misc_feature (306)..(306): n is a, c, t, g, unknown, or other
  misc_feature (316)..(316): n is a, c, t, g, unknown, or other
  misc_feature (331)..(331): n is a, c, t, g, unknown, or other
  misc_feature (337)..(337): n is a, c, t, g, unknown, or other
  misc_feature (352)..(352): n is a, c, t, g, unknown, or other
  misc_feature (470)..(470): n is a, c, t, g, unknown, or other
tggagctccccgcggtggcggccgctctagaactagtggatcccccgggctgcaggaattcgcacgagaccattacctagaacatcctaatcgaaaactcccgcgaccgcccggtgtctgtccgtcgccaagtcgtgctgggctgccgagcggagctccagctcgtttgtcctctcggctcctgcgactggcctccggcaaagtgggagccgcgtcctcagcatccgtgccaaggttgccactggggcctgcannnagggcctgcattgcggatgatggagcggaaaagcccgtggaagctcagnntgatgctcgntcttggccctggaangatggnatcagtgtggacggnccaggtctttttgggggccttcagggaaaccccaagggggggggaaagtgtgttttcaacaccttcttttggagggggttttatggaaaatttgtgccgcgtcccctttttttgtggntgcaaattttttccaaaaggcccacccccctttttgggaaaccgggg

SEQ ID NO: 34073 - protein, 81 aa, Zea mays
  misc_feature: Ceres CLONE 1412410-F
  misc_feature (11)..(11): Xaa is any aa, unknown, or other
  misc_feature (12)..(12): Xaa is any aa, unknown, or other
  misc_feature (15)..(15): Xaa is any aa, unknown, or other
  misc_feature (20)..(20): Xaa is any aa, unknown, or other
  misc_feature (22)..(22): Xaa is any aa, unknown, or other
  misc_feature (27)..(27): Xaa is any aa, unknown, or other
MMERKSPWKLXXMLXLGPGXMXSVWTXQVFLGAFRETPRGGESVFSTPSFGGGFMENLCRVPFFCGCKFFPKGPPPFLGNR

SEQ ID NO: 34074 - DNA, 637 bp, Zea mays
  misc_feature: Ceres CLONE 1412411-F
  misc_feature: Encodes the peptide sequence at SEQ ID NO. 34075
gctctagaactagtggatcccccgggctgcaggaattcgcacgagaccattacctagaacatcctaatcgaaaaattacggctgaagggagtcgctcgccgccgcgttcgaggcgttccctcgtcgcggtcgcgccgtcgaccttcaccgctcgctgtcaggtctgcccgccacgacctcgccggccacactcgcagctcgccctcgctcctacgcctcgccggcgaggccttctgccttttcgcgccctctatctggtgcgatctttggagcatcgttctcttctctcacttgagatccagacccctaaaccctagagctcgccgcttccgctcgctcgctccgcgctggcggcgacaatggaggacgaggagatggagaaaaaggtgcagcagtacttgcagcgcaagggtttccgcctcactgagcttgcgctccaggaggagtgcaaccgcctctccacctccgccatctccgacgatgcgcttgcacggtctgacaatgatccagcgagatactactatggatatagcagattaagaacatgggcatacagttctcttgatcaatataagcacgaattacttcgcgtcctttatccaggtttcatccatagctccctggatctagtgggaga

SEQ ID NO: 34075 - protein, 92 aa, Zea mays
  misc_feature: Ceres CLONE 1412411-F
MEDEEMEKKVQQYLQRKGFRLTELALQEECNRLSTSAISDDALARSDNDPARYYYGYSRLRTWAYSSLDQYKHELLRVLYPGFIHSSLDLVG

SEQ ID NO: 34076 - DNA, 703 bp, Zea mays
  misc_feature: Ceres CLONE 1412415-F
agagctggagctccccgcggtggcggccgctctagaactagtggatcccccgggctgcaggaattcgcacgagaccattcctagaacatcctaatcgaaaaccacctccaaagtccaaaagtgaagcctacgcccgtcccatacggtgaaaacgtcggaaccctagatccctctcacggtcgcgcctgtgctccaaaaccttagatccgacatgcatcagcccagagcccgctacccacccgggtatggctccagcgtcggaggcgatgacgaccaaggcgctagtgcagtacgaagaggaggccgagccctgtgatgaaacttctctcactagtgccggactgacatgaacagattcaacaccgctacgagcagcagcaccagcactctctatagagaactcctcgtagcagcagcagtggctgctccgagaccaggtgcccgccgttgtgacctcagtgtctgcacgcgctgtgctctccatggcgcctcaggtggacgctgttgactccttctccgacgattgcgacgcctactaaatatcctacctgcgtaccggttaccggatagacgatgccctagcagctcactgcgacggggttcaggatcatcctcgcttcgcgaccgagttatgctactattgattaaacgattggaaatgggtctgcatgttcgtgaacaacattcctacggcctcgccggg

SEQ ID NO: 34077 - DNA, 674 bp, Zea mays
  misc_feature: Ceres CLONE 1412421-F
  misc_feature: Encodes the peptide sequence at SEQ ID NO. 34078
  misc_feature (330)..(330): n is a, c, t, g, unknown, or other
  misc_feature (331)..(331): n is a, c, t, g, unknown, or other
  misc_feature (350)..(350): n is a, c, t, g, unknown, or other
ctggagctccccgcggtggcggccggctctagaactagtggatcccccgggctgcaggaattcgcacgagaccattacctagaacatcctaatcaaaaacaacaatataactggcgatgtctcttctctgatgaactgcttcagcctcaatatcttaaatgtgtcatacaataatttggctggtgctgtccctactgacaacaacttcacacggttttcacatgacagctttttaggtaatcctggactctgtggatattggcttcgttcttcatgtcgttccactggccatcaaggcaaaccgcccatctcaaaggctgccataattgnntgtgctgtgggtggacttngtatcctcctgatgatcttagtagctgtttgcaggccacaccatccacctgctttcaaagatgccactgtaaagcagccagtgagcaatggtccaccaaagctggtgatccttcaatatgacatggctcttcatggctttgaagaattaaggaggatgaactggaaactggagggaaaatacatcattggatacggggcatccaagactggttaaaaaaggggtcttaagaaattcacaccaaggggaaaaaaaaaattgtatgcccctacccctaaaactttaagggatttaaaactggcccccaaccttgtgggaaacccca

SEQ ID NO: 34078 - protein, 144 aa, Zea mays
  misc_feature: Ceres CLONE 1412421-F
  misc_feature: SWISSPROT Homolog: EC 2.7.11.1 Non-specific serine/threonine protein kinase
  misc_feature (67)..(67): Xaa is any aa, unknown, or other
  misc_feature (74)..(74): Xaa is any aa, unknown, or other
MNCFSLNILNVSYNNLAGAVPTDNNFTRFSHDSFLGNPGLCGYWLRSSCRSTGHQGKPPISKAAIIXCAVGGLXILLMILVAVCRPHHPPAFKDATVKQPVSNGPPKLVILQYDMALHGFEELRRMNWKLEGKYIIGYGASKTG

SEQ ID NO: 34079 - DNA, 678 bp, Zea mays
  misc_feature: Ceres CLONE 1412427-F
atagctggagctccccgcggtggcggccgctctagaactagtggatcccccgggctgcaggaattcgcacgagaccattacctagaacatcctaatcgaaaaagagcgctctggcaactgctcacatttgcgcagaacaggttggacgcggaatgcgttccatggatgctcacgccgccgccggctaccgcggaggtgcggcaccagcagctttctcgccactactgctcatcactatccgttcgcgcggcttcttcggcgggacgctccgcttcagtggtgattgaggttgggctctcatcaatatcgtcgtcgcatatggactatcgtgctctagtcaccaaccctgtggatgagcatggcttgtgatctcaactagtaactgcccccatcgcttccgagacaccacctttgtagtcactcagagtgccgaccatttgtccccgtttatatcttccctccctcccataagattattcgctggtggcggatttggaaaaaagggcgcggttcgaagctggtgtggtcgctcaattgtgcggaaagaaaggccagtgttatgtgtgaagtactgaatgctagcaggtaggctggctctcgcctcgccgagcgatggatctcgagttcggtaggcgcctgaggtccccaaagagagactcgtggaagaccaccttgctg

SEQ ID NO: 34080 - DNA, 633 bp, Zea mays
  misc_feature: Ceres CLONE 1412431-F
  misc_feature: Encodes the peptide sequence at SEQ ID NO. 34081
  misc_feature (215)..(215): n is a, c, t, g, unknown, or other
  misc_feature (220)..(220): n is a, c, t, g, unknown, or other
  misc_feature (221)..(221): n is a, c, t, g, unknown, or other
  misc_feature (226)..(226): n is a, c, t, g, unknown, or other
  misc_feature (227)..(227): n is a, c, t, g, unknown, or other
  misc_feature (233)..(233): n is a, c, t, g, unknown, or other
  misc_feature (327)..(327): n is a, c, t, g, unknown, or other
  misc_feature (419)..(419): n is a, c, t, g, unknown, or other
  misc_feature (421)..(421): n is a, c, t, g, unknown, or other
  misc_feature (472)..(472): n is a, c, t, g, unknown, or other
  misc_feature (473)..(473): n is a, c, t, g, unknown, or other
aagctggagctccccgcggtggcggccgctctagaactagtggatcccccgggctgcaggaattcgcacgagaccattacctagaacatcctaatagaaaaacatcgcaccgcacccaataaaacgccacaccacgccaccggggtccagggtccatccatcactcacgagcaggatcgagtcgaggcctcagctccctcctcggcgtcctcgcnaacgnnaaggnnaaaggnaacaatgtcagcggctcgtcgtcggtccccaatccccgttctcctcttcttcctcctcctccactccgcgtcgccgagccccatcaagacggtnggtggtgctgggtgatgggagaaaaccgctccccttcgaaccacaatggctggggggtgggaatggaagcggctgaacccggagatcgacgncntgacggggccggaagtggaaccccggccaacgccggtcggaacccgggggnngggggggggtctacttccgcgacggggccccgtacgtgggacccgggacccggggccactcgtttccaggaaattcgggagggaggtttttcggtttcgaagaaaaaaccccggggaaaaacccgcccccaaggaaacggttttccccaaaaaagggcgc

SEQ ID NO: 34081 - protein, 34 aa, Zea mays
  misc_feature: Ceres CLONE 1412431-F
MSAARRRSPIPVLLFFLLLHSASPSPIKTVGGAG

SEQ ID NO: 34082 - DNA, 681 bp, Zea mays
  misc_feature: Ceres CLONE 1412442-F
  misc_feature: Encodes the peptide sequence at SEQ ID NO. 34083
tccccgcggtggcggccgctctagaactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcggcggctgtaaagcgtcgagttttcgtgcagctgtcggagcgataggaagtgtccgggtctcgagcccgggcgcaagtacttcttcacacgcaacactccactattgtcggttttgccatcggggcataatacgatgcttggcaaatgggttccacattcatgcggtgcacactctggcagccccttgcctgaagcttcaagccctgtctccaggggaacccaaaggagggtttccctgtgggggcctgtccacctaaacgcccggggggtgccgg

SEQ ID NO: 34083 - protein, 32 aa, Zea mays
  misc_feature: Ceres CLONE 1412442-F
MATVAPVVSDLVDFLNASPTAFHAVDEAKRRL

SEQ ID NO: 34084 - DNA, 673 bp, Zea mays
  misc_feature: Ceres CLONE 1412444-F
  misc_feature: Encodes the peptide sequence at SEQ ID NO. 34085
  misc_feature (330)..(330): n is a, c, t, g, unknown, or other
  misc_feature (335)..(335): n is a, c, t, g, unknown, or other
  misc_feature (504)..(504): n is a, c, t, g, unknown, or other
  misc_feature (529)..(529): n is a, c, t, g, unknown, or other
  misc_feature (616)..(616): n is a, c, t, g, unknown, or other
  misc_feature (622)..(622): n is a, c, t, g, unknown, or other
tccccgcggtggcggccgctctagaactagtggatcccccgggctgcaggaattcgcacgagaccattacctagaacatcctaatcgaaaaatccaacgacccacactgagacgtcccctccccgctccgtcctctctcctctgccgccgagacgacgcgatggcggggtccgccgccttgccgccgctcgccgccttcgcgtcgctccttaccgcgcggcgcttcgccgccgccaggtccgcgctccggtccctgctcacgccgcgcctactggggcggtgccgttcgcggacctcgccgcctcgtcgctcccgcgcggcgcgccgcgncacgnccgtgggtggcgttccacgacatgctcttccgcgcgtacggcggacgcgggcgcggcgtgccgcgcggccgaggcgctcgacggccgccgtgtcccgcctcggcagcctcgacccgcgctcgctcacgttctcgctgctctcgctccgccgcgccgggcgcctcgcggnacgccgcgggccttcctggagcggnccgctcggctcgtgccccgggctccgtctcgccggtcgccggggtccgttcgtcgtcgacggtcttttgtgggtcggggtgtggggncggcgnccggccggctggtcgtcgttttgcctcgccccgggcggggggctgcatggc

SEQ ID NO: 34085 - protein, 171 aa, Zea mays
  misc_feature: Ceres CLONE 1412444-F
  misc_feature (57)..(57): Xaa is any aa, unknown, or other
  misc_feature (59)..(59): Xaa is any aa, unknown, or other
  misc_feature (115)..(115): Xaa is any aa, unknown, or other
MAGSAALPPLAAFASLLTARRFAAARSALRSLLTPRLLGRCRSRTSPPRRSRAARRXTXVGGVPRHALPRVRRTRARRAARPRRSTAAVSRLGSLDPRSLTFSLLSLRRAGRLAXRRGPSWSGPLGSCPGLRLAGRRGPFVVDGLLWVGVWGRRPAGWSSFCLAPGGGLHG

SEQ ID NO: 34086 - DNA, 612 bp, Zea mays
  misc_feature: Ceres CLONE 1412448-F
  misc_feature (265)..(265): n is a, c, t, g, unknown, or other
  misc_feature (308)..(308): n is a, c, t, g, unknown, or other
  misc_feature (310)..(310): n is a, c, t, g, unknown, or other
  misc_feature (311)..(311): n is a, c, t, g, unknown, or other
  misc_feature (313)..(313): n is a, c, t, g, unknown, or other
  misc_feature (315)..(315): n is a, c, t, g, unknown, or other
  misc_feature (316)..(316): n is a, c, t, g, unknown, or other
  misc_feature (318)..(318): n is a, c, t, g, unknown, or other
  misc_feature (319)..(319): n is a, c, t, g, unknown, or other
  misc_feature (323)..(323): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (349)..(349): n is a, c, t, g, unknown, or other
  misc_feature (559)..(559): n is a, c, t, g, unknown, or other
ccccgcggtggcggccgctctagaactagtggatcccccgggctgcaggaattcgcacgagaccattacctagaacatcctaatcgaaaagcctccgccatttcttcatctcaatctccatccttccatcttccgctccctcccctgcttgcgctcgtcgcgcaggcgacctcggcgggctcggctcggcctctcagcgacgggtcagcggcttcccctcctgcctctcgccagtcccctcggctctgttcctctgcgcaccggncggtgaccctgcgtgcgtgcctctttctctctctctctcctcncnncncnngnnctcntnnnnnnnnnnnnnnnnnnnnnnncncttcccccctttttgtaaaaacctcaaccgccccccccccccccaacaaattaacaccccagcccgcgggccgggggggaaaccgggaagccaaaggggcccgcggcttccacccaaagggggggccggcgccggcttttgtcggagccgttttgggggggtcatccgcccccagggggtaaagggggatcccccgctcacgcctttagncgggtttcggcggtaaaagggcccgccctttttttcataggaacccgcgggaa

SEQ ID NO: 34087 - DNA, 596 bp, Zea mays
  misc_feature: Ceres CLONE 1412457-F
  misc_feature (305)..(305): n is a, c, t, g, unknown, or other
  misc_feature (323)..(323): n is a, c, t, g, unknown, or other
gctctagaactagtggatcccccgggctgcaggaattcgcacgagaccattacctagaacatcctaatcgaaaaacgattccatacaggacctcacctccctactcgcgtagtagtcgtcgtcgtcgtcctcctcccgacgtctggtggtatcggacttgcgtggcgtggaggtgcttccgaacttgggatcgatttgcttgtcagcgccgaaccctagctttgcttcgacggcacccacctacggtacgcccgcggccccaagcagtcaggcgacaccgaataatttggttacagagacgagcnggtgcgccggcgagaggncccgattctcaccgcgccggcgatggcgagcagctcgtctccgtcacaggtcatctgcgcctccttcaatcagacaacagcatggttttctgtcggacccaaggatggggttcaagatctttgacgctccgaaatgggaggctctgctacgaaaagaaggcctgggggggatccaaacattgggggaaaaatgctattttgggaacaaaccttaacttggccatttggccgggacccggggaacaagcccggaatggcccccccccccgcggg

SEQ ID NO: 34088 - DNA, 653 bp, Zea mays
  misc_feature: Ceres CLONE 1412460-F
  misc_feature: Encodes the peptide sequence at SEQ ID NO. 34089
  misc_feature (481)..(481): n is a, c, t, g, unknown, or other
  misc_feature (497)..(497): n is a, c, t, g, unknown, or other
tccccgcggtggcggccgctctagaactagtggatcccccgggctgcaggaattcgcacgagaccattacctagaacatcctaatcgaaaactctcggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggaccagcagaacatcaaccgcttcggtcgcctcaacaaccgcctccacgagctccaggaagagatcaagctcgcaaaggagacgaatgagaaccttgatctcttcctgggtcacagtggagggcttgacgttgaaggcaatgaacttcctcgtttggtttatgtgctcggtgaaaaacgtcctggattccaacatcacaagaaaggctggtgcctgnaatgcactttgttcgnggtatcagctgtccttactaatgggcaatacatgttgaaatccttgatttgtgaccactacatcaataatagcaaggctcttcgaagaaactatgtgctttccttatggacaaaacttaagaaagggaagggggctggtatgcatttttcctcggg

SEQ ID NO: 34089 - protein, 143 aa, Zea mays
  misc_feature: Ceres CLONE 1412460-F
  misc_feature: SWISSPROT Homolog: EC 2.4.1.12 Cellulose synthase (UDP-forming)
  misc_feature (87)..(87): Xaa is any aa, unknown, or other
  misc_feature (92)..(92): Xaa is any aa, unknown, or other
MQQGDGTEAQVTWEDQQNINRFGRLNNRLHELQEEIKLAKETNENLDLFLGHSGGLDVEGNELPRLVYVLGEKRPGFQHHKKGWCLXCTLFXVSAVLTNGQYMLKSLICDHYINNSKALRRNYVLSLWTKLKKGKGAGMHFSS

SEQ ID NO: 34090 - DNA, 640 bp, Zea mays
  misc_feature: Ceres CLONE 1412471-F
  misc_feature: Encodes the peptide sequence at SEQ ID NO. 34091
  misc_feature (313)..(313): n is a, c, t, g, unknown, or other
  misc_feature (331)..(331): n is a, c, t, g, unknown, or other
  misc_feature (338)..(338): n is a, c, t, g, unknown, or other
  misc_feature (345)..(345): n is a, c, t, g, unknown, or other
ggagctccccgcggtggcggccgctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggnaacagccggccccgccgncgcaggngctccgntctacctctccctctccgcccggtggccgcgcactctgctcggattgctggtgagatgcccaaagccttttgtgatcttagatgatgttgtgcaacacaccctgactaatttggacaggattcacaaaagcttactaattttgggagggcaaagggtgaggggacaaaatcctcagaaaggggactttatggatatttgaaagagggtccaggggccttttgtggatgcaacttatcaaacccctccctaaacttcgggagggaatgggaggccctggtccaataaattttggct

SEQ ID NO: 34091 - protein, 99 aa, Zea mays
  misc_feature: Ceres CLONE 1412471-F
  misc_feature (70)..(70): Xaa is any aa, unknown, or other
  misc_feature (72)..(72): Xaa is any aa, unknown, or other
MATSPPQNPSSGEPSDASSLAAAALEAPVRVWRSLVARFPPLPDSSSFLAGVSDLQLRYFGNSRPRRRRXSXLPLPLRPVAAHSARIAGEMPKAFCDLR

SEQ ID NO: 34092 - DNA, 644 bp, Zea mays
  misc_feature: Ceres CLONE 1412472-F
  misc_feature: Encodes the peptide sequence at SEQ ID NO. 34093
  misc_feature (408)..(408): n is a, c, t, g, unknown, or other
ggagctccccgcggtggcggccgctctagaactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacgccgatgctgggcctgcgcctgtgggtgctagtggcatcgccgtcggggcccgcctcgtgctgctcctcgtgttcatctccctcacctcgccgagaggggntgaaagggcccagaaaggtgataaagacgggcacgtgccgaaccgggggggggtcactaataaacccgaacccggtacacacgttggaaagggttactcagggggcgtccagtcaggggccaatccctccccccattcgggtgataggccacggaaggtaaatcggggattatacggatccccccctggaaccgcgggaaaaaaacggctttccgaatgggccgttggtctccaaa

SEQ ID NO: 34093 - protein, 104 aa, Zea mays
  misc_feature: Ceres CLONE 1412472-F
  misc_feature (52)..(52): Xaa is any aa, unknown, or other
MSPPPPPPLLRNELSRRTPMLGLRLWVLVASPSGPASCCSSCSSPSPRREGXKGPRKVIKTGTCRTGGGSLINPNPVHTLERVTQGASSQGPIPPPIRVIGHGR

SEQ ID NO: 34094 - DNA, 708 bp, Zea mays
  misc_feature: Ceres CLONE 1412477-F
  misc_feature (708)..(708): n is a, c, t, g, unknown, or other
aaagctggagctccccgcggtggcggccgctctagaactagtggatcccccgggctgcaggaattcgcacgagacctttacctagaacatcctaatcaaaaagacgtccacagtgcgccgtgttctgccgcgcctgcgttcccaccgcgtgtccgcaactctgccccacctcacatccgcgtccgcaatccgcgcctccgccgccgcagcccttcctccgcgcagcgtccgtccatccatggctctccctacacgcagtgtcgtgccgctttccgcaatccgtgcctcaatccccttccttcgcgcagtgcccttccatccatggctcgcttccagaaatcccctacctacggcgcagcgtcgcagtcaggaatccgcccccaaaatcactacccgctctgcggcgatggaagggaatcaatccgtcaatggaaggaacacgtgcttcccccttccatcctcggcgctgcgcggattgcggattgcatggccatcgtttcgcgccccaatccgtcgatgcaaggaacgcgtgcttcccccttccatcctcggcgctgcgcgaattgcagattgcatggtcatcgtttcgccccagttcattgcccgcatcagatggaagggtgccccgatccgcctcacctccatcaaatgagtgcctgcctttcttgcatggagacgccaaagagaaggaacctatcactaagtcgn

SEQ ID NO: 34095 - DNA, 620 bp, Zea mays
  misc_feature: Ceres CLONE 1412478-F
  misc_feature: Encodes the peptide sequence at SEQ ID NO. 34096
  misc_feature (376)..(376): n is a, c, t, g, unknown, or other
  misc_feature (427)..(427): n is a, c, t, g, unknown, or other
gctctagaactagtggatcccccgggctgcaggaattcgcacgagaccattacctagaacatcctaatcgaaaactcctcttctccagcgtccgatccccgtttcccacgaatcccactctactcctccatctgcggcctcctccatgctcctgcccccttctctctcctccttgcttccccgcgcgcacgtttttacaagggtttcggcggaggcgaccggtcgccgacgatggcggacgacagcggcagccacgagggcggcggcggcggcggcgacgacgtccgggagcaggacatgttcttgcctattaccaacatcacccggatcatgaagaaggccgtcccggccaatgccaagatcactaaggacgctnaggagataatgcagtactgcgtctccgagttcatattcttttgtgaccaancgaggccaggggaaaaaagccaaaagggggggggggttaaaaaaaaaaaacaccgggaaaaattttcttttggcggggaaaacccgggattcaagaaaggggattttccccgggtttcccaaaaaaaaaaaaaaaaaccgaaaaaaccccgggttaccccccggggggggggttaaaacccccaccccctcct

SEQ ID NO: 34096 - protein, 123 aa, Zea mays
  misc_feature: Ceres CLONE 1412478-F
  misc_feature (23)..(78): Pfam Name: CBFD_NFYB_HMF Pfam Description: Histone-like transcription factor (CBF/NF-Y) and archaeal histone
  misc_feature (49)..(49): Xaa is any aa, unknown, or other
  misc_feature (66)..(66): Xaa is any aa, unknown, or other
MADDSGSHEGGGGGGDDVREQDMFLPITNITRIMKKAVPANAKITKDAXEIMQYCVSEFIFFCDQXRPGEKSQKGGGVKKKKHREKFSFGGENPGFKKGDFPRVSQKKKKKPKKPRVTPRGGG

SEQ ID NO: 34097 - DNA, 712 bp, Zea mays
  misc_feature: Ceres CLONE 1412479-F
  misc_feature: Translation starting site: 185
  misc_feature: SWISSPROT Homolog: EC 3.5.1.52 Peptide-N(4)-(N-acetyl-beta-glucosaminyl)asparagine amidase
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (521)..(521): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcaaaaaacaacaacaacaaccatctccaacgcagcaagcagacacagggacaggcaggcagcgagtgcaaccgcgagagcgatcagcgatgggctccttcttctcgaccttagtgacgccccctccgcccgccgtcgacgacccgaactgcgccgtggtggccgcgcactccaaggccacctacgacgagcagtgggcggcccacaagagcagcagcaagctgatggtgatcgacttctcggcgtcctggagcggaccctgccgattcatcgagccggccttcaaggagctggcctcccgcttcaccgatgccatcttcatcaaggacgacgtcaacgagctcgcggaggtcgcaaggacatggaaggtagaggcgatgccaacgctcgtgctggctagtggggaaaaagggagtaannnnnaanctgctctccatagagcgtactcccccaattgaagaggtgatcagcacaggagtcgtgccgcgattcattgagtgtcttacacgtgaggaccatccacaactcctgtttgaggctgcatgggcgctcatcaacattgcatcaggtatctcagagaacactaaggtggnggttgagagtgtggctgtgcccat

SEQ ID NO: 34098 - DNA, 710 bp, Zea mays
  misc_feature: Ceres CLONE 1412486-F
  misc_feature (149)..(149): n is a, c, t, g, unknown, or other
  misc_feature (163)..(163): n is a, c, t, g, unknown, or other
  misc_feature (164)..(164): n is a, c, t, g, unknown, or other
  misc_feature (364)..(364): n is a, c, t, g, unknown, or other
  misc_feature (416)..(416): n is a, c, t, g, unknown, or other
  misc_feature (422)..(422): n is a, c, t, g, unknown, or other
  misc_feature (424)..(424): n is a, c, t, g, unknown, or other
  misc_feature (426)..(426): n is a, c, t, g, unknown, or other
  misc_feature (436)..(436): n is a, c, t, g, unknown, or other
  misc_feature (448)..(448): n is a, c, t, g, unknown, or other
  misc_feature (504)..(504): n is a, c, t, g, unknown, or other
  misc_feature (534)..(534): n is a, c, t, g, unknown, or other
  misc_feature (545)..(545): n is a, c, t, g, unknown, or other
aaagctggagctccccgcggtggcggccgctctagaactagtggatcccccgggctgcaggaattcgcacgagaccattacctagaacatcctaatcgaaaaagtcagttcctcctactcccgatccatttgcagagggcagcagccancctcctcctccccnngcggccgagctcgcgcctcgcccgccgcctgaactcgtcttgcctgcggccgatctcccccctccgttcttcgccgcaacccggagaggagaccgcgctcggtcgagcaccccctggggcagcgtcctcgcgaccagctccggcgcggcgtccgccctcagcagcccgggtgtccccgggaacgtctccggctcggccgncacacagctcgacaggcttttcagttcagtgcagtgtaccaaagatctctgntaattngngnatgagatcangtaactgataangacatgtgaagaaccagtgatcagtaatctgtacgcttcaagattgtagatccttngagatggatgaaagagatcaggcttatggnaaaatctggtngataatcatgggaaggtcagcagttctgggctgaactagactataaaaaaacggggcttcatttccaatttccatggagaaatgggggttccccaacgtattaaaaggaattgtgactttatctcgcccaagggtcccaacttgaggggggggtttccaatacca

SEQ ID NO: 34099 - DNA, 484 bp, Zea mays
  misc_feature: Ceres CLONE 1412487-F
  misc_feature: Encodes the peptide sequence at SEQ ID NO. 34100
aagctggagctccccgcggtggcggccgctctagaactagtggatcccccgggctgcaggaattcgcacgagaccattacctagaacatcctaatcgaaaagtgtgtctggaaaccctagccgccatatctcacgatccactcgagcaccaagccgagggaaggggaggagcgatggcgcgcggcgtggtgtcggcgaagggcggcgcggtcgcgggcaagaagaaggggtcggtttccttcacgatcgactgcaccaagccagtgtaggacaagatcatgcaggtcgcctcgctcgagaagttctgcacgagcgcatcaggtcgccgacgtcaagctggacacctcggcgactccgtcaccatctctcgcgagaagaccaaggtcagccgtcacctctgacgggaccctactccgagaggtaccctggagtacttggacccaaggaggtactttgaagaagggcacaaacgtgccggggattt

SEQ ID NO: 34100 - protein, 31 aa, Zea mays
  misc_feature: Ceres CLONE 1412487-F
MARGVVSAKGGAVAGKKKGSVSFTIDCTKPV

SEQ ID NO: 34101 - DNA, 704 bp, Zea mays
  misc_feature: Ceres CLONE 1412497-F
  misc_feature: Encodes the peptide sequence at SEQ ID NO. 34102
tggagctccccgcggtggcggccgctctagaactagtggatcccccgggctgcaggaattcgcacgagaccattacctagaacatcctaatcaaaactctcctatcttctctctctccatcgctccctcctccgcgccgcgttggcaccgaaccctcctgtcatggcaaggccgccgaaggaggcgattgataccttcatcagcatcacgggggcggacgaggccgtcgccgtacgcaaactcgaggaacatggtggtgatcttaatcgagcaataaattcacatttcaatgatggagacagcatattgaacggaaatcagtcaaacgccatgcctgctagtcgtgatgatatgatggacctggatggaccactggataatacatttcaaagatctttgttgccagagagtttcccgtgccccttttgctcaatggatccaaatttccaggaccaatttttggacaaagttggctccactggatgggggcattcgggaaccccctagtttcccattccaaaaagggggggggagaatccctatccaaggttaagggggggtgaccctcaaaacggggtcttctgggccgggatgtgtactggaaaaggggtttccaaagggccctgagaaaccccggaaaaaatataaaatttgagtagtgggcaccggggaatttatatttggccccctttggtttcccacaa

SEQ ID NO: 34102 - protein, 114 aa, Zea mays
  misc_feature: Ceres CLONE 1412497-F
MARPPKEAIDTFISITGADEAVAVRKLEEHGGDLNRAINSHFNDGDSILNGNQSNAMPASRDDMMDLDGPLDNTFQRSLLPESFPCPFCSMDPNFQDQFLDKVGSTGWGHSGTP

SEQ ID NO: 34103 - DNA, 720 bp, Zea mays
  misc_feature: Ceres CLONE 1412505-F
  misc_feature: Encodes the peptide sequence at SEQ ID NO. 34104
aaagctggagctccccgcggtggcggccgctctagaactagtggatcccccgggctgcaggaattcgcacgagaccattacctagaacatcctaatcgaaaaactccaccagtccggtccatctgctggacctcgattggtttcttcttacctaggaacatccggggatgtcgactcctgcgaggaagaggctgatgagggatttcaagcggttgatgcaggaccctccggccggcataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgttccatcctaacatttatgctgatggaagcatatgcttagatatcctgcagaatcagtggagtccgatatatgatgtagctgcgatactcacgtcaatccagtcattgttgtgcgatccaaacccgaattcgcccgctaactctgaagccgcccgcatgttcagcgagaacaagcgagagtacaaccgcaaagttcgggaggtcgtggagcagagctggacggcggatgatgatgccctgtgttgcgtcgcgctgtgctgcgcagctgctcactgcgccccgcaacacaggtcagcctcagccaccgaccgttgcaccagctcgc

SEQ ID NO: 34104 - protein, 184 aa, Zea mays
  misc_feature: Ceres CLONE 1412505-F
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFKRLMQDPPAGISGAPQDNNIMLWNAVIFGPDDTPWDGGTFKLTLQFNEEYPNKPPTVRFVSRMFHPNIYADGSICLDILQNQWSPIYDVAAILTSIQSLLCDPNPNSPANSEAARMFSENKREYNRKVREVVEQSWTADDDALCCVALCCAAAHCAPQHRSASATDRCTSS

SEQ ID NO: 34105 - DNA, 701 bp, Zea mays
  misc_feature: Ceres CLONE 1412506-F
  misc_feature: Encodes the peptide sequence at SEQ ID NO. 34106
  misc_feature (627)..(627): n is a, c, t, g, unknown, or other
  misc_feature (650)..(650): n is a, c, t, g, unknown, or other
aagctggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagacgggcgtcgtggccaccatcaccggccccgccgcgggccccgtgttcgcgctccgcgccgacatggacgcgctccccatccaggaaatggtagaatgggagttcaagagcaaggaagacgggaagatgcatgcgtgcggccatgacgcccacgtggcgatgctttctggagcagctaggntgcttcagtctcggagggacganttaaggtactgatagtttttttggctggcttttttgccagagatattcaga

SEQ ID NO: 34106 - protein, 136 aa, Zea mays
  misc_feature: Ceres CLONE 1412506-F
  misc_feature: SWISSPROT Homolog: EC 3.5.1.14 Aminoacylase
  misc_feature (126)..(126): Xaa is any aa, unknown, or other
  misc_feature (133)..(133): Xaa is any aa, unknown, or other
MAAAPALARELLDAAREPEFAEWQRGVRRRIHQHPELAFQEHRTSALVRAELDAIGVPYAWPVAQTGVVATITGPAAGPVFALRADMDALPIQEMVEWEFKSKEDGKMHACGHDAHVAMLSGAARXLQSRRDXLRY

SEQ ID NO: 34107 - DNA, 778 bp, Zea mays
  misc_feature: Ceres CLONE 1412509-F
  misc_feature (778)..(778): n is a, c, t, g, unknown, or other
agagctggagctccccgcggtggcggccgctctagaactagtggatcccccgggctgcaggaattcgcacgagaccattacctagaacatcctaatcgaaaactctctcgcgcgtccgcgcccgcgcccgcggcctcgttcaatccgccagcgctcccccgccccccggtggtagcgggctctacggcagcgctcctctccggttcccctgcgctccgcgtcttcatctgtggcggccgacgctccgtcggtgtctcgtcggacggagcgagcggagctagggttccgtttcatgctcaggatcggcgagatctagggtctcgatttcagggtgattgtactggatagctgctgctgatattgcaagacaatgaaagctcatcagcagaagggtaatgcatctggcacaggagcaaagaccaaatcttttttttgaaaaaatacaaagcctgaaagttgggtgcccctattcaaacaaatcctccgggcaatggggcttggcaaagcgaaaaaagggtctccccccttttgaaatccctaccccaaaaggcaagatatgccctccaaagacctggggggtttttattggaaagccccccaaaacgggggagcctaaagttgtgctggctcgggccaccttaaaacccctctggggaaagaacaaaaagtctaccacctttttccccctttaaagtgagaacctccttcgcaaggaggatttacggccaaaaaaaaaaaacaaccccaccccgtctacccctgggaatggcgccctttn

SEQ ID NO: 34108 - DNA, 684 bp, Zea mays
  misc_feature: Ceres CLONE 1412510-R
  misc_feature (1)..(1): n is a, c, t, g, unknown, or other
  misc_feature (684)..(684): n is a, c, t, g, unknown, or other
ncgattgggtaccgggccccccctcgaggtcgacggtatcgataagcttttttttttttttttttggacgagaacttctttcaagttaccttagcgatgcccagcaggaataccagacaaaaatcgccccaatgcaaggggaaaagaatgacacgcaaaacgactaaatcctgactataccattgctttaccatctgggctttacttggcttctgctcatttggagcaaaccgaacggggtcggcctcttgatcttgatcttcatgaagaatcttgatccatttcaacatcacgatcatcttcacctgcctctaacaggtctgcatcaccatcaagatttattcgttttgcacgcttgcgttcttgctttatttcaccaacgtttttagttacatagcgctgataaggttcatcaagcatctctcctagctggagatcatacctctgctgttcctcgtcggaatccatttccccatcagaatcttcaggaccttgactatccgcattatcaccgtgctccatatcatcttccacatcggtctctgaagattcaacagcttcaagatcttttccgcccttattaacacttatagaaaacaggccatgatcgccataatcatctgctgtaacatcaacctgcattcctgttgcttcgccagcttaaacaattgctcgacactgttn

SEQ ID NO: 34109 - DNA, 741 bp, Zea mays
  misc_feature: Ceres CLONE 1412510-F
  misc_feature (723)..(723): n is a, c, t, g, unknown, or other
aaagctggagctccccgcggtggcggccgctctagaactagtggatcccccgggctgcaggaattcgcaggagaccattacctagaacatcctatattcatatgaaatagatcaatggaattgacattgaagatcttctttaatctctcatgcggcaaaatcttcctcctattgttttggtcttgaagattattttctctgaatatatgcctaaagtttcttgactacctcgggcctggctaagtccgaggcgtctacaaactcttgaagtgccggtgaatgactgtctaattttggatcgccaccacccctctttttgccatcattacctcgctgcttcttccggaggccgctgctattcatcatcctcgcattcctcctcctcctcctcctctgagagctcctcgaccacgaccgtcgatgatggcactggatgatgtatagctcctccttcagcgtctagtagcatctctccatcatcgcccgaagtggatgctgagtactacgagaccatcctcgtcgtactcatgaaccttcccgacgatcgcctcctggactgggatggttgaatgaaatatcgctcccccttcgccaatctgggaccccctttccattaaaccccttggaggaagaggaggaaagggggtttccccacccccctcccccccccaagggaaactttcgccctcaaaaaacaaaagatttttgtgcaatgggtttaanttttcccccctctcaaaa

SEQ ID NO: 34110 - DNA, 684 bp, Zea mays
  misc_feature: Ceres CLONE 1412514-F
  misc_feature: Encodes the peptide sequence at SEQ ID NO. 34111
  misc_feature (680)..(680): n is a, c, t, g, unknown, or other
caaagctggagctccccgcggtggcggccgctctagaactagtggatcccccgggctgcaggaattcgcacgagaccattacctagaacatcctaatcgaaaaactccaccagtccggtccatctgctggacctcgattggtttcttcttacctaggaacatccggggatgtcgactcctgcgaggaagaggctgatgagggatttcaagcggttgatgcaggaccctccggccggcataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgttccatcctaacatttatgctgatggaagcatatgcttagatatcctgcagaatcagtggagtccgatatatgatgtagctgcgatactcacgtcaatccagtcattgttgtgcgatccaaacccgaattcgcccgctaactctgaagccgcccgcatgttcagcgagaacaagcgagagacaaccgcaaagttcggggaggtcgtggagcaaagctggacgggactgagatggcccccccgtgtgtgggcgtccgcgctggtgctgcgcagctgctcactgcngccc

SEQ ID NO: 34111 - protein, 172 aa, Zea mays
  misc_feature: Ceres CLONE 1412514-F
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
  misc_feature (171)..(171): Xaa is any aa, unknown, or other
MSTPARKRLMRDFKRLMQDPPAGISGAPQDNNIMLWNAVIFGPDDTPWDGGTFKLTLQFNEEYPNKPPTVRFVSRMFHPNIYADGSICLDILQNQWSPIYDVAAILTSIQSLLCDPNPNSPANSEAARMFSENKRETTAKFGEVVEQSWTGLRWPPRVWASALVLRSCSLXP

SEQ ID NO: 34112 - DNA, 708 bp, Zea mays
  misc_feature: Ceres CLONE 1412515-F
  misc_feature: Encodes the peptide sequence at SEQ ID NO. 34113
  misc_feature (652)..(652): n is a, c, t, g, unknown, or other
  misc_feature (653)..(653): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggcgacgaggtgtcggcggtggacgacaagggccggctcaagagatcacgggcgtcaagcccaagagatgctgcctgtggtcaccctccacgagatctgcgtcgacgacccgccacggataagctccactgcaagggtcatcggcggctggtccgcagcttccccgtcgaggccttcaagccgaggagccgcgccgcccggaccgggcgtgtctttcccaggacgcggagaggagagacagggnnaaaaagtcgatctttnaacaactccccaatccctgaacccccagggcccccgtcc

SEQ ID NO: 34113 - protein, 178 aa, Zea mays
  misc_feature: Ceres CLONE 1412515-F
  misc_feature (2)..(147): Pfam Name: DUF538 Pfam Description: Protein of unknown function, DUF538
  misc_feature (160)..(160): Xaa is any aa, unknown, or other
  misc_feature (165)..(165): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGDEVSAVDDKGRLKRSRASSPRDAACGHPPRDLRRRPATDKLHCKGHRRLVRSFPVEAFKPRSRAARTGRVFPRTRRGETGXKSRSXNNSPIPEPPGPPS

SEQ ID NO: 34114 - DNA, 698 bp, Zea mays
  misc_feature: Ceres CLONE 1412516-F
  misc_feature: Encodes the peptide sequence at SEQ ID NO. 34115
  misc_feature (396)..(396): n is a, c, t, g, unknown, or other
  misc_feature (446)..(446): n is a, c, t, g, unknown, or other
  misc_feature (462)..(462): n is a, c, t, g, unknown, or other
  misc_feature (463)..(463): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaaaccaagcaggcgacacccgttcggtccgtacaggaggggtccaccatgccgtgctcctcctcttcgtcgtccaaccccttccactccctcgcctccgccttccccttcctctcctccacatccccacccccatccccacccgcctcgcccgcgcccgccgctccccacctcgccgtcccgctcctcctccccgtctcctcggcttccgagtcccgccgcggggcgcagccgctgccgggcacgcggatggtcggcgcgggcgcgaccggcgggggtaacatggccagcggtggntggggggcccgcgttcgtggggcagggtgtcaccatgctcgacccatccnggaaacggctcatggnncgttacacacgcttcgagctcccgcgcttcctcaccaacaggactcctatgtggnttcaaaggatgctatcaccgtcgagaagactgaaatagtccagtatttaggttttttatggatctgatgggtgcagtattctatgtaaggcactaatgggccaagcgggatgggggggccttggccccttgaggaccaatgaactttcagggaaaacctccaatgttcccatttgtccaa

SEQ ID NO: 34115 - protein, 145 aa, Zea mays
  misc_feature: Ceres CLONE 1412516-F
  misc_feature (100)..(100): Xaa is any aa, unknown, or other
  misc_feature (106)..(106): Xaa is any aa, unknown, or other
  misc_feature (124)..(124): Xaa is any aa, unknown, or other
MPCSSSSSSNPFHSLASAFPFLSSTSPPPSPPASPAPAAPHLAVPLLLPVSSASESRRGAQPLPGTRMVGAGATGGGNMASGGWGARVRGAGCHHARPIXETAHGXLHTLRAPALPHQQDSYVXSKDAITVEKTEIVQYLGFLWI

SEQ ID NO: 34116 - DNA, 712 bp, Zea mays
  misc_feature: Ceres CLONE 1412518-F
  misc_feature (236)..(236): n is a, c, t, g, unknown, or other
  misc_feature (359)..(359): n is a, c, t, g, unknown, or other
  misc_feature (361)..(361): n is a, c, t, g, unknown, or other
  misc_feature (362)..(362): n is a, c, t, g, unknown, or other
aagctggagctccccgcggtggcggccgctctagaactagtggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttcccaatcaccatagagccnggttgatccccaaaggcccatggttttctccgacgccgcgtcgcctctcgtagccaccgccgctgactctgcttcctcctgcgtcgcccacctccctgctgctgtcgcgttaagtgttgccgntnngtgtgaagacgcgtagctcgaggggtcgtgatttctcgccgatcggttcgggaaactgtaaactatggatttccccggggcccgaatcggagaacctctcggtcggggttgaattttcatggcccaccgcccacccttcgggggattggggaaaccccgccccttgtgccttttttaaaaaaaacaaaaaccggaaggcccccgggggccggggaggccccacccgagaaggaaaaaaaggggaaagtggtggaaaaaaaaattttccccccccccggggacccccccttgtgggaaaaggcccccgcggccccccaaaaaaggggtggggggggggggggagaaaaaaa

SEQ ID NO: 34117 - DNA, 662 bp, Zea mays
  misc_feature: Ceres CLONE 1412519-F
  misc_feature: Encodes the peptide sequence at SEQ ID NO. 34118
  misc_feature (371)..(371): n is a, c, t, g, unknown, or other
aaagctggagctccccgcggtggcggccgctctagaactagtggatcccccgggctgcaggaattcgcacgagaccattacctagaacatcctaatcgaaaactcgtctccctcccgtatctgcaagccttgatcccgccgccagccatccatccaagggagccatgtctccatccggcgagctgctggcttccatctcctccgtcttcactgtcgccttcgtcctcctcgcctgcgtcgagctcggcgacgccgccgccgccgccgtcggcgtctaccgcctcatccagtacgacctcgccggcgctccgctcggctcccgcgccgcggtcctcaaccaccacgctgccgcgctcccgctccccgccggngcagacctctcccgctccgccctcgtcgcgccgctcctcgacctcccgctctctttcctcagagagtacctggtggagaaaaaacatctggggggattactcattcctgctcccgaaaaataatgacagtgtggatgacaaggggcaattcaaaggtgtactgactgaactggaaaaattgcttctgcatgaaccaattcccatatccggggcactttgcttttgcaggacgacaatcttgaaaaccccggtgggaagaaacccaaaaaattggccttcccaaggcaaacc

SEQ ID NO: 34118 - protein, 109 aa, Zea mays
  misc_feature: Ceres CLONE 1412519-F
MSPSGELLASISSVFTVAFVLLACVELGDAAAAAVGVYRLIQYDLAGAPLGSRAAVLNHHAAALPLPAGADLSRSALVAPLLDLPLSFLREYLVEKKHLGGLLIPAPEK

SEQ ID NO: 34119 - DNA, 740 bp, Zea mays
  misc_feature: Ceres CLONE 1412521-F
  misc_feature: Encodes the peptide sequence at SEQ ID NO. 34120
  misc_feature (452)..(452): n is a, c, t, g, unknown, or other
  misc_feature (467)..(467): n is a, c, t, g, unknown, or other
  misc_feature (517)..(517): n is a, c, t, g, unknown, or other
  misc_feature (526)..(526): n is a, c, t, g, unknown, or other
  misc_feature (618)..(618): n is a, c, t, g, unknown, or other
  misc_feature (657)..(657): n is a, c, t, g, unknown, or other
  misc_feature (736)..(736): n is a, c, t, g, unknown, or other
aagctggagctccccgcggtggcggccgctctagaactagtggatcccccgggctgcaggaattcgcacgagaccattacctagaacatcctaatcgaaaagaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatgcagcaaccatacttaagatgttggaagttgagcatccagccgccaaggttcttgttgagttggctgagctccaagatcgtgagggtagagatggaactacttccngtgtcatcatagcgncagagttactcaagagaggcaatgatcttgtgaagaaatagatccatccnacctctatnatcagtggctacaggcttgctatgcgtgaagcctgcaaatatgttgaggaaaagtagcagtcaagggtgacaaacttggaaaaagatccccntatcactctgcaaaaactagcatgtcttcgaaattgatnaatagtgacagtgatttctttgcaacttttggttgtgaggccagtcaagccgtgagactacaatggccaggagacgtgnatat

SEQ ID NO: 34120 - protein, 113 aa, Zea mays
  misc_feature: Ceres CLONE 1412521-F
  misc_feature (96)..(96): Xaa is any aa, unknown, or other
  misc_feature (101)..(101): Xaa is any aa, unknown, or other
MAITAPTPDILGERQSGQDVRTQNVMACGAVANIVKSSLGPVGLDKMLVDDIGDVTITNDAATILKMLEVEHPAAKVLVELAELQDREGRDGTTSXVIIAXELLKRGNDLVKK

SEQ ID NO: 34121 - DNA, 719 bp, Zea mays
  misc_feature: Ceres CLONE 1412522-F
  misc_feature: Encodes the peptide sequence at SEQ ID NO. 34122
  misc_feature (516)..(516): n is a, c, t, g, unknown, or other
  misc_feature (517)..(517): n is a, c, t, g, unknown, or other
  misc_feature (605)..(605): n is a, c, t, g, unknown, or other
  misc_feature (606)..(606): n is a, c, t, g, unknown, or other
  misc_feature (619)..(619): n is a, c, t, g, unknown, or other
  misc_feature (662)..(662): n is a, c, t, g, unknown, or other
  misc_feature (670)..(670): n is a, c, t, g, unknown, or other
ggagctccccgcggtggcggccgctctagaactagtggatcccccgggctgcaggaattcgcacgagaccattacctagaacatcctaatcgaaaaaaaacccggtttcacactagttctgtattcgtgtcctctggtctctcgcaggccaaacaaaagcgccgctgccgccggcaatgttccgccgcctcctcccccaccgtcgctacatctccacctcgcccgcctccaactccaacccgaccctctactctgacggaaccatcccattctctatcctctcgtggggccgtggcgcttccggacagctcggcggtggcaaggaggagcgccgcctctacccatcccccgtcgcccacctacttctccccgaatcagacccacgccttgctccccaccccggacgccttccctctgcagaggagacgtctggagtggaggttgggatctcttgtgggctcttccactcctcgctcctcgtcgaaggaggcgcctgggtgtggggcaagggcgacnngagccgcctcggcctcggtgacgagtcttccgccttcgtgccccgctctaaccccaaatctcgcgatctccgcctccttgcgcttggnngcatccactccgncgcgctgaccacttcccgtgacgtcttcacctggggttatggntgatttgnagctctggggtcacatgtataccatagggagcttttggcaagcaaaggg

SEQ ID NO: 34122 - protein, 162 aa, Zea mays
  misc_feature: Ceres CLONE 1412522-F
  misc_feature (114)..(114): Xaa is any aa, unknown, or other
  misc_feature (144)..(144): Xaa is any aa, unknown, or other
  misc_feature (148)..(148): Xaa is any aa, unknown, or other
MFRRLLPHRRYISTSPASNSNPTLYSDGTIPFSILSWGRGASGQLGGGKEERRLYPSPVAHLLLPESDPRLAPHPGRLPSAEETSGVEVGISCGLFHSSLLVEGGAWVWGKGDXSRLGLGDESSAFVPRSNPKSRDLRLLALGXIHSXALTTSRDVFTWGYG

SEQ ID NO: 34123 - DNA, 788 bp, Zea mays
  misc_feature: Ceres CLONE 1412525-F
  misc_feature: Encodes the peptide sequence at SEQ ID NO. 34124
  misc_feature (465)..(465): n is a, c, t, g, unknown, or other
  misc_feature (496)..(496): n is a, c, t, g, unknown, or other
catagctggagctcaccgcggtggcggccgctctagtaactagtggatcccccgggctgcaggaattctcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgccgacggagatcgtgaaccgcggcgtggagccgtcgggccgggacgccggttccgcggccttctcggtgcgcgtgcgccgccgcctgccggacttcctgcaggcggggaaccctcaagtacgggcgcctggggtaccactacctcttcacccacgggcgggtacctggccccccatccccgtcaccccgcctggtgtgccgggccgaagcggggcagccctcagccccnaaccaccctggggggcaaggggggggggggnagggccccccacggacctcccccaccggggcacggccttccacgcccggggcatcggccttccacaaacgcccggcctaacatcatgtgtccaggccccacgccccgaggacccttagtcacccttcctcattgtaacaagcccgcgcgaaccaacctcagaggtgccccaaaggggcaagttgtgtcgaccctggggcggcaaaaccccgggccatgtttcaaaaggagaaattcgacgccttccccgtccctggttgtggtggggccaaatgccggctatccgcccgcag

SEQ ID NO: 34124 - protein, 134 aa, Zea mays
  misc_feature: Ceres CLONE 1412525-F
  misc_feature (86)..(86): Xaa is any aa, unknown, or other
  misc_feature (96)..(96): Xaa is any aa, unknown, or other
MAREEQALLPTEIVNRGVEPSGRDAGSAAFSVRVRRRLPDFLQAGNPQVRAPGVPLPLHPRAGTWPPIPVTPPGVPGRSGAALSPXPPWGARGGGXGPPTDLPHRGTAFHARGIGLPQTPGLTSCVQAPRPEDP

SEQ ID NO: 34125 - DNA, 611 bp, Zea mays
  misc_feature: Ceres CLONE 1412529-F
  misc_feature (476)..(476): n is a, c, t, g, unknown, or other
  misc_feature (511)..(511): n is a, c, t, g, unknown, or other
aaagctggagctccccgcggtggcggccgctctagaactagtggatcccccgggctgcaggaattcgcacgagaccattacctagaacatcctaatcgaaaatttagtccggatgggcagtttcttgctactggaggggaagatggagttgtcagggtctggggcgtcgcgcagtctgaggactgcaaaatcccaatggatgatccttcttgtgtttacctcaaagctcatcgccagagtggcttgggtcctgttgatgctgacaatgagaagaaatgcaaagttaagggcgtgaagcaatctgcagattctgcctgtgttgtgattccaacagtggtgttccagatctcaagcaacactgcatgagttccgtggtcactctggtgacgtactgagtctgtcatggtctaacaacagcatctactgtcagcatcaacagacaaatctgttcccttgtgggaaattggatctgcaanctgcatcactgttttcccgcaccagcaacttgggnaggcctataggctcttacttggctgctccaaaacttttcaactatgcttcttgatttggacctccccatttcccttatgaaaaatttatttttggaaggg

SEQ ID NO: 34126 - DNA, 668 bp, Zea mays
  misc_feature: Ceres CLONE 1412531-F
  misc_feature: Encodes the peptide sequence at SEQ ID NO. 34127
aaagctggagctccccgcggtggcggccgctctagaactagtggatcccccgggctgcaggaattcgcacgagaccattacctagaacatcctaatcgaaaaactgattgtccacccaccactctacgcaagcaatccttcggacttcggtgggggaaatggaggccgccgccgccgccgagacggggctcgcccagaaaccggttgtgctgtacccttcgccggggatgggccacctggtctccatgatcgagcttggcaagatcctcggcgcgcggggactgtccgtaataattgtcgtcgtcgagcctcccttcaacacgggcgctacgtcgcctttcctcgccggcgtctccgcggacaacccgtccatctccttccaccgcctgcccaaagtcgagcgcctcccgcccgtcaagaccaagcaccaggaggcgctcaccttcgaggtcacccgcgtctccaacccgcacctccgcgagttcctggccgccgcgtccccagccgtgctcgtcgtcgacttcttctgcagcatcgccctggacgtggcggaggagctccgcgtgcccgcctacttcttcttcactcggccgcaaggtcctggcctttcttctgcccctcccgggaatcacgagcggacgccgcgagcttccagacatggggaagag

SEQ ID NO: 34127 - protein, 170 aa, Zea mays
  misc_feature: Ceres CLONE 1412531-F
  misc_feature: SWISSPROT Homolog: EC 2.4.1.218 Hydroquinone glucosyltransferase
MEAAAAAETGLAQKPVVLYPSPGMGHLVSMIELGKILGARGLSVIIVVVEPPFNTGATSPFLAGVSADNPSISFHRLPKVERLPPVKTKHQEALTFEVTRVSNPHLREFLAAASPAVLVVDFFCSIALDVAEELRVPAYFFFTRPQGPGLSSAPPGNHERTPRASRHGEE

SEQ ID NO: 34128 - DNA, 670 bp, Zea mays
  misc_feature: Ceres CLONE 1412532-F
  misc_feature: Encodes the peptide sequence at SEQ ID NO. 34129
  misc_feature (552)..(552): n is a, c, t, g, unknown, or other
  misc_feature (655)..(655): n is a, c, t, g, unknown, or other
ggagctccccgcggtggcggccgctctagaactagtggatcccccgggctgcaggaattcgcacgagaccattacctagaacatcctaatcgaaaaatcacttgttcttcttcgagctaccagctgcctatcatggtcatcatggtcgagctgctgcccccacttgcctctctaatcctcagtcctctgtagagctggtcctcctacccctcactttgccttgagcaatttggtttctagcatctgtggggtggcttgtgggtggtcgccttggactgctccttcctccacctgccgcgccggcagggcgacgaggtccaaaagcctggtggtgctcatcatcaagaacaccgaagcggcgagagtgccatgccatctgatccgaggcggagctcgaggagctgaggactgtacgtgctcttggatccggtagagatcacgtgccctcgtgttcgtccccggccgccgcgatggggaacacgtgcgtctgccccagcatcaccatgaacggcttcttccagtccgtgtccacggcgctgtggaagacgccgnaggaaagagacgcgctgccccgcgccgccaatggccccggctgcgccagcccgggccggtcgcagtcggcgctgtcgaagccggcgtccgacgtgcaccaccntcgccgtgcaaagca

SEQ ID NO: 34129 - protein, 66 aa, Zea mays
  misc_feature: Ceres CLONE 1412532-F
  misc_feature: SWISSPROT Homolog: EC 2.7.11.1 Non-specific serine/threonine protein kinase
  misc_feature (28)..(28): Xaa is any aa, unknown, or other
  misc_feature (62)..(62): Xaa is any aa, unknown, or other
MGNTCVCPSITMNGFFQSVSTALWKTPXERDALPRAANGPGCASPGRSQSALSKPASDVHHXRRAK

SEQ ID NO: 34130 - DNA, 696 bp, Zea mays
  misc_feature: Ceres CLONE 1412534-F
  misc_feature: Translation starting site: 408
  misc_feature (490)..(490): n is a, c, t, g, unknown, or other
  misc_feature (609)..(609): n is a, c, t, g, unknown, or other
aagctggagctccccgcggtggcggccgctctagaactagtggatcccccgggctgcaggaattcgcacgagaccattacctagaacatcctaatcgaaaagtagcggttacctccctttcgctctactgctctctctctctctctggaccttgccgttctctccctcgtcggcaatcagcccgcttcctgtgctctctatgctccccttccgttcgtagcctcggccttcgtctccctccatggacccgcgctaaatgcatcgcgagattccaaaccggtagcgtttcttcctgctccatccgccgcaagatgtaagcaagggcctcacttcacacccggagtgggagaccatccagaatacatcctcagatcttcttgtgtctgagaaaaaagcgacgcccttcaatggaggagagcttcgtgccctttgcgggcatcaagaacgacctcccacggaggctcgcctgctacaaagcagactgggccgnaggggtccgtgccggtatcaggatcctggcgccgacgacctactattcttcgcgtcggcgataccggtcatatcgttcgggaagcaattggaagagaacactgatggagtcctcccggnagtgaaaacgtggcatccactgggctgggcgcgtaatccctccatccgggagggcaccgcttgtatcctggaatcccccaacgacgt

SEQ ID NO: 34131 - DNA, 654 bp, Zea mays
  misc_feature: Ceres CLONE 1412535-F
  misc_feature: Encodes the peptide sequence at SEQ ID NO. 34132
tggagctccccgcggtggcggccgctctagaactagtggatcccccgggctgcaggaattcgcacgagaccattacctagaacatcctaatcgaaaacccactagtaccgccacacgaattcccgaccccgatggcgacatcgccaccgcacaaccctagctccggcgagccctccgatgcgttgagcctcgcagtcgcaccgatcgaggcgcccgtgcgcgtatggagatccctactcgcgcgcttccctcgcctccaggactcctccagcttccttgctggcgtctccgacctccagctccgctacttcggcaacagtcgggcgcgccgccgcaggggctccgctctacctctccctctccacccggtgaccgcgcactctgctcgcattgctgatgagatgtccatagcctttgtgatcttatatgatgtcgtgcaacacgccctgactaatttgcacagcattcacagaagcttactattatggcaggccaaggctgatgcaacaaattctctgaaagcgcactctatgatatttgagagaggcccatgggcctttgctcgtgcaacatatcatacactcactagactcgggagaaatggacgccctgccaatacattctgcattctgcatctgatatgggtcgacaaaa

SEQ ID NO: 34132 - protein, 174 aa, Zea mays
  misc_feature: Ceres CLONE 1412535-F
MATSPPHNPSSGEPSDALSLAVAPIEAPVRVWRSLLARFPRLQDSSSFLAGVSDLQLRYFGNSRARRRRGSALPLPLHPVTAHSARIADEMSIAFVILYDVVQHALTNLHSIHRSLLLWQAKADATNSLKAHSMIFERGPWAFARATYHTLTRLGRNGRPANTFCILHLIWVDK

SEQ ID NO: 34133 - DNA, 652 bp, Zea mays
  misc_feature: Ceres CLONE 1412536-F
  misc_feature: Encodes the peptide sequence at SEQ ID NO. 34134
ggagctccccgcggtggcggccgctctagaactagtggatcccccgggctgcaggaattcgcacgagaccattacctagaacatcctaatcgaaaaattcctcttctctcctcccctccctcggcctttctcccatccccgttcgaagaagccgccaataccgcggcagtcgaggatggcggcggcggcaccacccgacgggcaggaaaaggtgattgcggcggcgcagcacatcgtcaagtcgctcgccagctccaagaacgccgccgacgacatgatccgcatcctctccggcttcgacaactgcctctcgttcatgtccgacctcttcccttctccccctgccgccaccgtcgttggttccatcctggaggcggacgaggcgacccagggggagggggacgagcccgactacgacgaagacgacgccgctgcccggtccgaggcgcagtgggacgtggcgcccgaggtggtcgagcgccggcagccccccgctgctggggaagcgctggtgctccactcgcgggagcgcgccgaggagtacctcgccgcggtcggctgcctcgcgggcgcgccgggcagcgcgccgaagccgccctgccggccgccatgaggcggctcgaggacgaattccgcacctgctcgggcgggg

SEQ ID NO: 34134 - protein, 145 aa, Zea mays
  misc_feature: Ceres CLONE 1412536-F
MAAAAPPDGQEKVIAAAQHIVKSLASSKNAADDMIRILSGFDNCLSFMSDLFPSPPAATVVGSILEADEATQGEGDEPDYDEDDAAARSEAQWDVAPEVVERRQPPAAGEALVLHSRERAEEYLAAVGCLAGAPGSAPKPPCRPP

SEQ ID NO: 34135 - DNA, 740 bp, Zea mays
  misc_feature: Ceres CLONE 1412538-F
  misc_feature: Encodes the peptide sequence at SEQ ID NO. 34136
  misc_feature (500)..(500): n is a, c, t, g, unknown, or other
  misc_feature (501)..(501): n is a, c, t, g, unknown, or other
  misc_feature (606)..(606): n is a, c, t, g, unknown, or other
  misc_feature (712)..(712): n is a, c, t, g, unknown, or other
aaagctggagctccccgcggtggcggccgctctagaactagtggatcccccgggctgcaggaattcgcacgagaccattacctagaacatcctaatcgaaaactcgccgcaacgaattcccggtctccaaccagccggccagccaccgcagacgacccctagttccgcgtccccgacccgaaccctcgagttcgcacgggctccggccagattcgcgcggtctaagcttcgaatcggcgcatggaggcagcagtagccgcggcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggcctcctggtcccccctcggagtctctgccaccgtcctcgtcgatggcgccgctcaggatggaatcgcccgcgnngcagctactctcccagattcttcacacgcacccgcacctactgcctggcgccgccgagcagcagctcgagctgctccagaccgaccgcgaggcagagaggataanggataggagagcgatgctggcgacaagctggctccgacaggggtcgacctcatgctgtacaggcggattgcctcagtaaaggagaggaacggaggaggactttggnagaaaaactctatgctctggttggtgga

SEQ ID NO: 34136 - protein, 71 aa, Zea mays
  misc_feature: Ceres CLONE 1412538-F
  misc_feature (11)..(11): Xaa is any aa, unknown, or other
  misc_feature (46)..(46): Xaa is any aa, unknown, or other
MAPLRMESPAXQLLSQILHTHPHLLPGAAEQQLELLQTDREAERIXDRRAMLATSWLRQGSTSCCTGGLPQ

SEQ ID NO: 34137 - DNA, 746 bp, Zea mays
  misc_feature: Ceres CLONE 1412539-F
  misc_feature: Encodes the peptide sequence at SEQ ID NO. 34138
  misc_feature (570)..(570): n is a, c, t, g, unknown, or other
  misc_feature (571)..(571): n is a, c, t, g, unknown, or other
  misc_feature (602)..(602): n is a, c, t, g, unknown, or other
  misc_feature (657)..(657): n is a, c, t, g, unknown, or other
  misc_feature (746)..(746): n is a, c, t, g, unknown, or other
aaagctggagctccccgcggtggcggccgctctagaactagtggatcccccgggctgcaggaattcgcacgagaccattacctagaacatcctaatcgaaaaacaatccacccgcgtcggcacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgcctccctggagggcctccgcccacgcgccgtcatcctctccggcgggccccactcagtccacgcccccggggcgcccgccttccccgagggattcctgggcttcgcggctgccgcaggcgcgcacgtgctcggcgtctgctatgggatgcagctcctcgtgcagtccctcggaggcgccgctgtgtccggtgatgcgcagcagtacgggaaaatggacnngtgagtgactgctggctcctccgcgctctancggcaggcggagaccgtgaagcgccagacggtgtggatgagccatggcgaccagntgctaagctgccagaagggtcgacgtggttgctcacagcgtgcagggagccgtcgccgtctttgatacccgggagatcgcttttatggn

SEQ ID NO: 34138 - protein, 127 aa, Zea mays
  misc_feature: Ceres CLONE 1412539-F
  misc_feature: SWISSPROT Homolog: EC 6.3.5.2 GMP synthase (glutamine-hydrolyzing)
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAAVSGDAQQYGKMD

SEQ ID NO: 34139 - DNA, 686 bp, Zea mays
  misc_feature: Ceres CLONE 1412540-F
  misc_feature: Encodes the peptide sequence at SEQ ID NO. 34140
aaagctggagctcaccgcggtggcggccgctctagaactagtggatcccccgggctgcaggaattcgcacgagaccattacctagaacatcctaatcgaaaaactgcgatgtggatcatcttctcctatcacctgacctccacacaatcacacaatacagagtggcgcgcggaagaaaaaatgcattcatatatgtgcgctcgttgagctgtgatgtcccccttcatgggacggtgcgcctcatcatgatcgagtcagtggagctaaggtagtcgctgatcaactagtatctgcctgtcagaatgacttagatgcactgtgtgccagctgtgaagagttcggccagaaggaggtctgaaagatgcgtccgcacgaggactgctgcaaaaccatcaagggcttacacgcgcaggcgtcctgcatctgcgactacggctgctccccggacgccaggaataagctagacctgaacaaggggttcttcgttaccaaagagtgcggcggcaccgtccccaagggctgcggatcaaagcaggactgaagagcgggtgaatctgaatggaggaaggtggctaacatacgcacggtagctacaaatacttataggaataaataaagttggccaactgttggttccatgggggtaggaacaaaaacaactggactgtttcttatccttcatttag

SEQ ID NO: 34140 - protein, 59 aa, Zea mays
  misc_feature: Ceres CLONE 1412540-F
MRPHEDCCKTIKGLHAQASCICDYGCSPDARNKLDLNKGFFVTKECGGTVPKGCGSKQD

SEQ ID NO: 34141 - DNA, 654 bp, Zea mays
  misc_feature: Ceres CLONE 1412544-F
  misc_feature: Encodes the peptide sequence at SEQ ID NO. 34142
  misc_feature (288)..(288): n is a, c, t, g, unknown, or other
  misc_feature (293)..(293): n is a, c, t, g, unknown, or other
  misc_feature (294)..(294): n is a, c, t, g, unknown, or other
  misc_feature (296)..(296): n is a, c, t, g, unknown, or other
  misc_feature (321)..(321): n is a, c, t, g, unknown, or other
  misc_feature (338)..(338): n is a, c, t, g, unknown, or other
  misc_feature (353)..(353): n is a, c, t, g, unknown, or other
caaagctggagctccccgcggtggcggccgctctagaactagtggatcccccgggctgcaggaattcgcacgagaccattacctagaacatcctaatcaaaaattccctccctagcccagccagggaaccagtctcagtgaatcccgcgcccggatcaatctcgcccaaggaagcagctcttcacgacttgcttccagatccatccatccatccatccgaggttgggccgtgggggtgtcggtgcggtgggaaatggggaaggggatcagcggcgacgcccgcctcgnctcgnngncttacgaccagtgggtgctgctgangcccggcggggggtcgncgcggccggccgggnggtacaggatgctggccaagtggtctagaaagctgtacgttgtccgagggagtctcaacggcgtttctatcggacggccaggttttgatttaaacatcctctttgggcacgtttaagcctggtaaagggtctaacatccccaacctgaaattgaggcccagggggatcggttcccagattagaagggcacagtatgggcaaagggaaaaattatttcccgggcccgaaatggggagacaagggcccccatcatcattaaataggggttccggtttgggttattggtgtggcaacccaaaag

SEQ ID NO: 34142 - protein, 71 aa, Zea mays
  misc_feature: Ceres CLONE 1412544-F
  misc_feature (12)..(12): Xaa is any aa, unknown, or other
  misc_feature (14)..(14): Xaa is any aa, unknown, or other
  misc_feature (15)..(15): Xaa is any aa, unknown, or other
  misc_feature (23)..(23): Xaa is any aa, unknown, or other
  misc_feature (29)..(29): Xaa is any aa, unknown, or other
  misc_feature (34)..(34): Xaa is any aa, unknown, or other
MGKGISGDARLXSXXYDQWVLLXPGGGSXRPAGXYRMLAKWSRKLYVVRGSLNGVSIGRPGFDLNILFGHV

SEQ ID NO: 34143 - DNA, 720 bp, Zea mays
  misc_feature: Ceres CLONE 1412546-F
  misc_feature: Encodes the peptide sequence at SEQ ID NO. 34144
  misc_feature (570)..(570): n is a, c, t, g, unknown, or other
aagctggagctccccgcggtggcggccgctctagaactagtggatcccccgggctgcaggaattcgcacgagaccattacctagaacatcctaatcgaaaaactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcggattgctggtgagatgcccaaagcctttgtgatcttagatgatgttgtgcaacacaccctgactaatttgcacagtattcacaaaagcttactatttttggcaggccagggctgagggaacaaattctcagaaagtgtactttatgatatttgagagaggtccaagggcctttggtgatgncacatatcaaacactcactagactcgggagcaatggacgccctggtcaatacattttgcattctgcatctgatatggtggccaacaaactcggtgccctgacaagtatgcaacactggttgggccggttttctggagaggttcattctgg

SEQ ID NO: 34144 - protein, 123 aa, Zea mays; identical to SEQ ID NO: 21279
  misc_feature: Ceres CLONE 1412546-F

SEQ ID NO: 34145 - DNA, 734 bp, Zea mays
  misc_feature: Ceres CLONE 1412547-F
  misc_feature: Encodes the peptide sequence at SEQ ID NO. 34146
  misc_feature (311)..(311): n is a, c, t, g, unknown, or other
  misc_feature (331)..(331): n is a, c, t, g, unknown, or other
  misc_feature (473)..(473): n is a, c, t, g, unknown, or other
  misc_feature (533)..(533): n is a, c, t, g, unknown, or other
  misc_feature (542)..(542): n is a, c, t, g, unknown, or other
tggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcgnagtggcagcgcggcgtgcgncgccggatccacagcacccggagctggccttccaggagcaccgcaccagcgcgctcgtgcgcgccgagctcgacgcgatcggcgtcccgtacgcctggccggtcgcgcagacgggcgtcgtggccaccatcaccggccccgncgcgggccccgtggtcgcgctccgcgccgacatggacgcgctccccatccagggaatggntagaatggnagttcaagagcaggaaacacggaagatgcatgcgtgcggccatgacgcccacgtggcgatgcttcttggagcagctaggttgcttcagcctcggagggaccgattaaaggaactgataagttttttgggctggcttttttggcagagaaaattcagaaatccgttctactaccgacagttgggaagctaatt

SEQ ID NO: 34146 - protein, 75 aa, Zea mays
  misc_feature: Ceres CLONE 1412547-F
  misc_feature: SWISSPROT Homolog: EC 3.5.1.14 Aminoacylase
  misc_feature (10)..(10): Xaa is any aa, unknown, or other
  misc_feature (13)..(13): Xaa is any aa, unknown, or other
MDALPIQGMXRMXVQEQETRKMHACGHDAHVAMLLGAARLLQPRRDRLKELISFLGWLFWQRKFRNPFYYRQLGS

SEQ ID NO: 34147 - DNA, 742 bp, Zea mays
  misc_feature: Ceres CLONE 1412548-F
  misc_feature: Translation starting site: 124
  misc_feature: SWISSPROT Homolog: EC 3.4.21.25 Cucumisin
  misc_feature (463)..(463): n is a, c, t, g, unknown, or other
  misc_feature (466)..(466): n is a, c, t, g, unknown, or other
  misc_feature (475)..(475): n is a, c, t, g, unknown, or other
  misc_feature (529)..(529): n is a, c, t, g, unknown, or other
  misc_feature (599)..(599): n is a, c, t, g, unknown, or other
  misc_feature (655)..(655): n is a, c, t, g, unknown, or other
caaagctggagctccccgcggtggcggccgctctagaactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacggcgcggcagtccatcttctactcctacaccaagagcagcatcaatggcttcgcggcgcacctggaggagtcggtcgcgcagcagatcgcggagcaccctgaggtgntgncggtgctgnagagcaagatgctcaagctgcacacccacgcgtcctgggacttcatggacctgnagcgcgacggtcacgtcctccctggctccatctggaaccacgctagggtcgggacaggacgtcatcatcngcagtctcgacagcggagtgtgccccgagtcccacagcttcccaaagacgacgcgncaagtgccagctcgctggaagggctcctgtcaggacacccgttagtacggtgcgcctgcaaccgaaaactctcggggctagggtctt

SEQ ID NO: 34148 - DNA, 754 bp, Zea mays
  misc_feature: Ceres CLONE 1412550-F
  misc_feature: Encodes the peptide sequence at SEQ ID NO. 34149
  misc_feature (486)..(486): n is a, c, t, g, unknown, or other
  misc_feature (523)..(523): n is a, c, t, g, unknown, or other
  misc_feature (743)..(743): n is a, c, t, g, unknown, or other
caaagctggagctccccgcggtggcggccgctctagaactagtggatcccccgggctgcaggaattcgcacgagaccattacctagaacatcctaatcgaaaatgtcataccccggctcctctgcttctcggttcccgccgttccatgtccgccacaaggtgcccgccacaagggcagaccggcggcagaggttgtaccgatcgctctggcccacgtcgccggccggaccatcaaccaccgcgcggagcatcaagcagctgccattccaaagcccgttgaagcatcgaaggatttccagccgtgagcgtgtgcggtggcggcgccgccgggtcgccgggatgggcaagatgaactgcttctccggcctgctcagcggcaagagcaaggcattcaagggtgccaacaagggcgcttacgcaaagaaggcggccagtggtggcaacgattgcccccaaggtgaagccggtagagttcgtagacatggncggcactgctgtcgacgacttcgtcggcagacgcggngaaggcagccgtcatggcgtccgcatgcagcagtaactttgtcgttcacgcagccacggagctgccaccccatgccactgccaaaaacggggaagaacaaggccgcgttttacaaggactctttctcccgccgcggttgtgtcgcccggtttacgaatttgccccatggcgccaagggaatcgccaaaagtgaccgccccctgctccaaaatggaaaaanggaaggccttc

SEQ ID NO: 34149 - protein, 138 aa, Zea mays
  misc_feature: Ceres CLONE 1412550-F
  misc_feature (62)..(62): Xaa is any aa, unknown, or other
  misc_feature (135)..(135): Xaa is any aa, unknown, or other
MGKMNCFSGLLSGKSKAFKGANKGAYAKKAASGGNDCPQGEAGRVRRHGRHCCRRLRRQTRXRQPSWRPHAAVTLSFTQPRSCHPMPLPKTGKNKAAFYKDSFSRRGCVARFTNLPHGAKGIAKSDRPLLQNGKXEGL

SEQ ID NO: 34150 - DNA, 868 bp, Zea mays
  misc_feature: Ceres CLONE 1412551-F
  misc_feature: Encodes the peptide sequence at SEQ ID NO. 34151
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (857)..(857): n is a, c, t, g, unknown, or other
  misc_feature (868)..(868): n is a, c, t, g, unknown, or other
tttctcctccttccgcccccggtgnnnnnngcccccnnccccaaagctggagctccaccgcggtggcggccgctctagaactagtgagatcccccgggctgcaggtaattcgcacgagaccattacctagaacatcctaatcgaaaaccccttgccctccgtccagctcgccgtctctcgcagagggaagcagggcgcagcagcgaccagttaccagtcatggttcgctgcgttgccggcagctgccctcccgtcaccttcgcgtgttgcccccgccggactggacgaagtgctgttgttcagtgtggcactgcatcgagcacaccagcaatatctggaactggaccttcatcatctggatcctcggggcttgtccaagattgtactgcccctctggtctgtgcactgaaattaactgccagacaagatgtttcctggtttcacttcccaggacaccccagaggaaaaggtggttccaatcctcctttggtcgaaattcctttggctcaggggcattttctgccttgacttggccggagcctacccgaagctgggatgaatcccttcctccccaaaaagggggcgaattctaagatggcccccaaaggcgaaacaacctcaacctgtttggggtccaatctaaaaaacttgggttccctttgccacacggaaaccatcctggggaaaatcccgcgccccagcgggaagggactaaccgggttctgtccggggcgacctacccccgattgtggccccccgaaacgtgcgcccatttttccgagcgacctccggccgctgtgagattgggacgggcgggggggggcgcccaagcatccatctaacccccccgaatcctntcctccggggn

SEQ ID NO: 34151 - protein, 102 aa, Zea mays
  misc_feature: Ceres CLONE 1412551-F
MVRCVAGSCPPVTFACCPRRTGRSAVVQCGTASSTPAISGTGPSSSGSSGLVQDCTAPLVCALKLTARQDVSWFHFPGHPRGKGGSNPPLVEIPLAQGHFLP

SEQ ID NO: 34152 - DNA, 578 bp, Zea mays
  misc_feature: Ceres CLONE 1412553-F
  misc_feature (238)..(238): n is a, c, t, g, unknown, or other
  misc_feature (262)..(262): n is a, c, t, g, unknown, or other
  misc_feature (286)..(286): n is a, c, t, g, unknown, or other
  misc_feature (326)..(326): n is a, c, t, g, unknown, or other
  misc_feature (328)..(328): n is a, c, t, g, unknown, or other
  misc_feature (334)..(334): n is a, c, t, g, unknown, or other
  misc_feature (335)..(335): n is a, c, t, g, unknown, or other
  misc_feature (378)..(378): n is a, c, t, g, unknown, or other
aaagctggagctccccgcggtggcggccgctctagaactagtggatcccccgggctgcaggaattcgcacgagaccattacctagaacatcctaatcgaaaaaacaccccacatcacaacagctccctctgcatctccgcctcgtcgccgtcgtctgcctgcacaaccttcttcttcatctctctctcttcttccgctgccaccctcccagcaccgaggggaagcaaagcccaccagnaaatctcgtcccgcttcccggcgncgtcccttctcataatcgcatcgnatctgtattgggttttcaggaaggagcagaaaacccctangnaatgcnnaaagatgggctgcacgtcaaaaactaactttggaaggacttgnaggaaaagacccaaatctttattttctgccaccctttggagagttcaagatcaaaaaaaccgtatttcccccctcgggttttccaaaaaggggtttaaaagggggggctaaaccccctcttttaaaaacccccttccgggggaaaggggagaaaatttccccccccctcccaaccctttttgtgggccaaaatttttttt

SEQ ID NO: 34153 - DNA, 748 bp, Zea mays
  misc_feature: Ceres CLONE 1412567-F
  misc_feature: Encodes the peptide sequence at SEQ ID NO. 34154
aaagctggagctccccgcggtggcggccgctctagaactagtggatcccccgggctgcaggaattcgcacgagaccattacctagaacatcctaatcgaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggctacagaatcgaggacgttcgcccagccggagaaatcaagaagttccagactgctgcttattccaactgcgtccgccaggcatcctgatatcgcctcaatgccaattcgcggaagagtaggtttttaattcagttttcctcttgggccggaaggtttccggtgggttctggtggccttcctcggcttcggaaattccaattgggctggcccatctccccttttccctcttcaacctccttttctggaaaacgttaccagtgggggagggttctcagagaattctgggggcccctcccccgccccccccattgggttttgaggggataagaaaaacccccccaaataactgtttccgtggggggcgggtttttgggaacccttgggggggggggccg

SEQ ID NO: 34154 - protein, 51 aa, Zea mays
  misc_feature: Ceres CLONE 1412567-F
  misc_feature (1)..(51): Pfam Name: AdoMetDC_leader Pfam Description: S-adenosyl-l-methionine decarboxylase leader peptide
MESKGGKKSSSSSSNFMYEAPLGYRIEDVRPAGEIKKFQTAAYSNCVRQAS

SEQ ID NO: 34155 - DNA, 744 bp, Zea mays
  misc_feature: Ceres CLONE 1412570-F
  misc_feature: Encodes the peptide sequence at SEQ ID NO. 34156
  misc_feature (701)..(701): n is a, c, t, g, unknown, or other
  misc_feature (702)..(702): n is a, c, t, g, unknown, or other
  misc_feature (708)..(708): n is a, c, t, g, unknown, or other
tggagctccccgcggtggcggccgctctagaactagtggatcccccgggctgcaggaattcgcacgagaccattacctagaacatcctaatcgaaaagaacacatacctaattatcacctgtaagccagctgaaccacatctcgtcgtgcacatccggagcccgggaacacacacacacattgccatggccatgcccatgcccaagcccgtcctgagcctgctcgtgcacctacacgccgccgtcctgttccttcccgccccggccggcggcgcggtctacaacgttctgcgctacggcgcgcgccccgacggcgtgacggacgcggcggggcccttcctccgcgcgtgggcggacgcctgccgctcgcccctcccggccgccgtgtacgtgccgccagggaggtacctggtgcggagcgccacgttcaccggcccgtgccacagccgcgccgtgacgttcgccgtcgccggcacggtcgtcgcccccgcggcctacggcgcgcgcggctcgtctggcaggtgcatcactttcgagaacatggacggcctcatcaggcgccaggagaggtatgctggacggccgagcctcggcgctctgggcctgcaaacagcgcgggcatcgcgacctgtccaacccccacgtcccgaccgaggatcgcccacttccaaacgactggggggggtgcaactttgccttccnnaaaaanctaaggtgttacacgggggggggggtggcagcgaac

SEQ ID NO: 34156 - protein, 186 aa, Zea mays
  misc_feature: Ceres CLONE 1412570-F
  misc_feature: SWISSPROT Homolog: EC 3.2.1.15 Polygalacturonase
  misc_feature (173)..(173): Xaa is any aa, unknown, or other
  misc_feature (175)..(175): Xaa is any aa, unknown, or other
MAMPMPKPVLSLLVHLHAAVLFLPAPAGGAVYNVLRYGARPDGVTDAAGPFLRAWADACRSPLPAAVYVPPGRYLVRSATFTGPCHSRAVTFAVAGTVVAPAAYGARGSSGRCITFENMDGLIRRQERYAGRPSLGALGLQTARASRPVQPPRPDRGSPTSKRLGGVQLCLPXKXKVLHGGGGGSE

SEQ ID NO: 34157 - DNA, 747 bp, Zea mays
  misc_feature: Ceres CLONE 1412571-F
  misc_feature: Translation starting site: 542
  misc_feature: SWISSPROT Homolog: EC 2.7.11.1 Non-specific serine/threonine protein kinase
  misc_feature (244)..(244): n is a, c, t, g, unknown, or other
  misc_feature (391)..(391): n is a, c, t, g, unknown, or other
  misc_feature (457)..(457): n is a, c, t, g, unknown, or other
  misc_feature (576)..(576): n is a, c, t, g, unknown, or other
  misc_feature (626)..(626): n is a, c, t, g, unknown, or other
  misc_feature (627)..(627): n is a, c, t, g, unknown, or other
  misc_feature (639)..(639): n is a, c, t, g, unknown, or other
tggagctccccgcggtggcggccgctctagaactagtggatcccccgggctgcaggaattcgcacgagaccattacctagaacatcctaatcgaaaaaatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaancattgtagctgtccctgtcgtcgtcgtcgtcgtcaacgaatccacacaaggaaaggatggagaagaagccgaccatcctcatgaacaggtacgagctcgggcgcacgctcgggcagggcaccttccgccaaggtgtaccacggcggnaccctcgcgtccgggcggagagcgtggccatcaaggtcatcacccaggaagaaggtgatgcgcgtncggcatgatcgaccagatcaagcgcgagatctccgtcatgcgcctcgtcgccacccccaacgtcgtgcagctgcaccgaaggtgatggccagcaagagcaagatatacttcgccatggnagtacggtccgggggcggcgagctcttcgcccgcgtcgcccgcggcgggnntcaaggaggacncccgcggagaaggtacttccaccagttcggtcgggggccgtcgacttctgcacccaggccgcggcgtctaccaccgcgacctcaagccgagaacttccctcgtcgacg

SEQ ID NO: 34158 - DNA, 742 bp, Zea mays
  misc_feature: Ceres CLONE 1412573-F
  misc_feature: Encodes the peptide sequence at SEQ ID NO. 34159
  misc_feature (362)..(362): n is a, c, t, g, unknown, or other
  misc_feature (398)..(398): n is a, c, t, g, unknown, or other
  misc_feature (425)..(425): n is a, c, t, g, unknown, or other
  misc_feature (441)..(441): n is a, c, t, g, unknown, or other
  misc_feature (456)..(456): n is a, c, t, g, unknown, or other
  misc_feature (457)..(457): n is a, c, t, g, unknown, or other
  misc_feature (503)..(503): n is a, c, t, g, unknown, or other
  misc_feature (537)..(537): n is a, c, t, g, unknown, or other
  misc_feature (627)..(627): n is a, c, t, g, unknown, or other
aaagctggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggccggggcggtgtccatggggacgcggcgggggcggccccgntcgccggcggcggtggtgggggagccgcgtggcggntgaagctcagggggtacttcgacctcngccaaagaggagatcngacaaggccgtgcgnncgctgaggagtggggggctccccgacgaggccaccgcgcactaccngcaacgcgatgcgggtcatgctcgaggccaaggncgcgcgcggtccccgatgccgtctcctccagcgaagagggggcagggtcagggtgtaccaggagaagatcgccaagtggcaggcccaggncgaggagcggctcagagtgcttggtcagaaaaagcggtggaggggccattggctgcaaaagtgcccaagaaggttgctgcaaacaatcctatcattaggactgcaaaaacagcgt

SEQ ID NO: 34159 - protein, 66 aa, Zea mays
  misc_feature: Ceres CLONE 1412573-F
  misc_feature (34)..(34): Xaa is any aa, unknown, or other
  misc_feature (46)..(46): Xaa is any aa, unknown, or other
  misc_feature (55)..(55): Xaa is any aa, unknown, or other
  misc_feature (60)..(60): Xaa is any aa, unknown, or other
  misc_feature (65)..(65): Xaa is any aa, unknown, or other
MSFLRSLADSFSSLLFSSGGRGGVHGDAAGAAPXAGGGGGGAAWRXKLRGYFDLXQRGDXTRPCXR

SEQ ID NO: 34160 - DNA, 784 bp, Zea mays
  misc_feature: Ceres CLONE 1412574-F
  misc_feature: Encodes the peptide sequence at SEQ ID NO. 34161
  misc_feature (411)..(411): n is a, c, t, g, unknown, or other
  misc_feature (571)..(571): n is a, c, t, g, unknown, or other
  misc_feature (623)..(623): n is a, c, t, g, unknown, or other
  misc_feature (715)..(715): n is a, c, t, g, unknown, or other
  misc_feature (774)..(774): n is a, c, t, g, unknown, or other
  misc_feature (775)..(775): n is a, c, t, g, unknown, or other
aagctggagctccccgcggtggcggccgctctagaacaagtggatcccccgggcttgcaggaattcgcaacgagaccattaccaagaacatcctaatcgaaaatgggattcgtttaaatgataatgattcattggaagcatatggtgttgacaagcaaaaactggtcgaagagataacccgtgcatacgctcatcaaatatactatgatggcttctttaacggcgaccctcatcctggcaattttcttgtgagcaaggaacctccacataaaccgattctccttgattttgggcttcactaagcgcataatcttgaatctatgaggcaggcactaacaaaaatgttttttgtcatgtgcagagggaaatcacgtggcactgctgtcatcattttcagaagatgggcttaanactgcgggttgacatgcctcagcaggcctatggatattgccacagtatttctttcgtcagtcaaccacagcaagtgaagcaaaggagaacataaaaacacttaatgaccaaagaagagagaaatgtcaaagctcttcaagaaaagatgaattgaccccangaaggaggttcaacgcttttaatcctgttgatgctttccccccggggagcantataatattttatgagggtcttgaatcctccttcagaggtctttcagcttcactaaatggtttaggaatagtttatctggacatcatgaggncatttgctgatcatttttttttgttagggagtttgacacacggaaaatacctaaaaagnncaagtggat

SEQ ID NO: 34161 - protein, 99 aa, Zea mays
  misc_feature: Ceres CLONE 1412574-F
AGAPRGGGRSRTSGSPGLAGIRNETITKNILIENGIRLNDNDSLEAYGVDKQKLVEEITRAYAHQIYYDGFFNGDPHPGNFLVSKEPPHKPILLDFGLH

SEQ ID NO: 34162 - DNA, 762 bp, Zea mays
  misc_feature: Ceres CLONE 1412578-F
  misc_feature: Encodes the peptide sequence at SEQ ID NO. 34163
  misc_feature (389)..(389): n is a, c, t, g, unknown, or other
  misc_feature (438)..(438): n is a, c, t, g, unknown, or other
  misc_feature (524)..(524): n is a, c, t, g, unknown, or other
  misc_feature (530)..(530): n is a, c, t, g, unknown, or other
  misc_feature (573)..(573): n is a, c, t, g, unknown, or other
  misc_feature (575)..(575): n is a, c, t, g, unknown, or other
  misc_feature (576)..(576): n is a, c, t, g, unknown, or other
aaagctggagctccccgcggtggcggccgctctagaactagtggatcccccgggctgcaggaattcgcacgagaccattacctagaacatcctaatcgaaaaacgcacctggggttttcgcgccgccgccgacatcgcaacaatgccgtcgcacaagaccttccggatcaagaagaagcttgtgtaaaaaatgcgccagaaccgccccatcccctactggatccgcatgcgcactgaccataccatcaggtacaacgccgagcgcaggctctggcgccgcaccaagatcggtttctgagcgtcgctattggccgtctgctgcgtcggaaggctagggtcgaagagctatcttctgtttatccattgtcgtctgtttctgtaagctagcntgtgatgctgtgatgcttttattaaattctgatgcagtggtgacgttancagaaaaattggcagtaactgtgttgtaccccaagattccttgcagcattgctatgctaagtaacgaacccttgatcttattaaantatggnagtgttgcagcaaaaaaaaaaaaaaaaaagcttatcgatccgncnnacccttcggaggggggggcccggtacccaattcgcccctatagtgagtcgtattacgcgcgctcactggggcgtcgtttttacaccgtcggtgactgggaaaaaccctggcgttacccaacttaatcgccttgcagcacatccccctttcgccagctgcggtaaatagcgaagagggccgcaccga

SEQ ID NO: 34163 - protein, 35 aa, Zea mays
  misc_feature: Ceres CLONE 1412578-F
  misc_feature (1)..(35): Pfam Name: Ribosomal_L39 Pfam Description: Ribosomal L39 protein
MRQNRPIPYWIRMRTDHTIRYNAERRLWRRTKIGF

SEQ ID NO: 34164 - DNA, 711 bp, Zea mays
  misc_feature: Ceres CLONE 1412583-F
  misc_feature (488)..(488): n is a, c, t, g, unknown, or other
aaagctggagctccccgcggtggcggccgctctagaacttagtggatcccccgggctgcaggaattcgcacgagaccatttacctagaacatcctaatcgaaaagaaaaagaagcgtatttcttcttcctcaccctcctcgaggaagagagagggcagctccggagccgcacgggcgcgagcgaggcaggcagtggctcctccccccttcctttcgatatcagctcatcgattcgtcctatcacacacatatcattaccgcttcctcttccttcacctatgcttgtcctctaactcattggcagaaaagaaaaaaaaagtcctttgttgattgtttgtatcgggttctggtggtgatgtttactggggtttccttgcccggttcttgatttgcgcaaggacagatttgccgtcctctcggggttcccgcccgtgcggtgctgaatcctccttccctgttcccttcccttaggtttggatcgggataangggatatgaaagtggacagaaagaagaatttgcagattggatccaggggggaaggaggttcagagcaagaatccgaggcgggaggagccgctggcatcggtcggaggtggacatggatgagccagacgctccctgagagcggtgacatggattgttgatggcaacaatggcagctccagagagagccccttgcagcccatggattcaagaattcccaggggct

SEQ ID NO: 34165 - DNA, 748 bp, Zea mays
  misc_feature: Ceres CLONE 1412584-F
  misc_feature: Encodes the peptide sequence at SEQ ID NO. 34166
  misc_feature (413)..(413): n is a, c, t, g, unknown, or other
  misc_feature (489)..(489): n is a, c, t, g, unknown, or other
ggagctccccgcggtggcggccgctctagaactagtggatcccccgggctgcaggaattcgcacgagaccattacctagaacatcctaatcgaaaaaaggtgttttgccctcttcttcgcgagcccccccgccgcatccagcagccgcatcggtagacccgcagccgccgatggcgaagaagcacagggacccagcctctgaggccgcgagcggcgactccccggccgcgtccatccgctccctcttctccgcggacaacccgttccgccggaaggcctctacggaggagccccccgcgactcctgcacccgccacgacgcccctccccatgcaacccagccgtgacgcccgggatgtcgagccgtcctcgaagaagaataagaagagcaaaggaggagggcccgcggcgcangcggaagcgggactgagttggaggccggccgggagcggcggcgaggcgcggagaatccgtcgagagtttgtgaagnaagaggaaggctcccgacgacgcgtcacaggggggtcgggttaggacgaagttaggaggcgttcgacgacgagaggaagctgctcagggacccgtgttcgtggtgaacctgccggtgcggaccaagcgtgaggagtttcatcatggagttcgcggcaagtcggggaggacgaagtacgtcggggtccgcttccgtgccgctggtcgactgaaacttttctagtgggagagtcgttttttaggggggaagaacctggggg

SEQ ID NO: 34166 - protein, 120 aa, Zea mays
  misc_feature: Ceres CLONE 1412584-F
  misc_feature (81)..(81): Xaa is any aa, unknown, or other
  misc_feature (107)..(107): Xaa is any aa, unknown, or other
MAKKHRDPASEAASGDSPAASIRSLFSADNPFRRKASTEEPPATPAPATTPLPMQPSRDARDVEPSSKKNKKSKGGGPAAXAEAGLSWRPAGSGGEARRIRREFVKXEEGSRRRVTGGSG

SEQ ID NO: 34167 - DNA, 771 bp, Zea mays
  misc_feature: Ceres CLONE 1412586-F
  misc_feature: Encodes the peptide sequence at SEQ ID NO. 34168
  misc_feature (369)..(369): n is a, c, t, g, unknown, or other
  misc_feature (370)..(370): n is a, c, t, g, unknown, or other
ggagctccccgcggtggcggccgctctagaactagtggatcccccgggctgcaggaattcgcacgagaccattacctagaacatcctaatcgaaaagtctttctccccttcctgctttccctctccagctctgcatacagaaacacacggagctagcagcacggatcgagagaacaatggaggaaacaagcaggatccctgggtacttcaagaacaagggcatcctgatcacgggcgcaacaggcttccttggaaagatcctcgtggagaagatactgagggtccaggcggacgtaaagaggatctacctccccgtgcgtgcgccgtatgctgcatcaacaagataacgttggagactgacgtgatcgnnaaaggagctgtttgtacttctgcgagagacgcacggcagaaggctccactcgtcatcgagggagaagggggtcccggttgccgggggaaatcatcacgagaactggggggggggaggggccccagctggagggggaggacttcggaagctcaacgtcctccgtcaatgggaactgccaaaacaaacttctaccaaaggggacgacgtggcccctggaacgggaacttggatgggaagggaagcataatctgccagttgggccaaagaaggcgcccaattggggggggcccccctccaggggccccggcccttatggggggggggggaaaaaacgggggaattttcttggggggggggttttaaagaggggggaacccctggggggggagaacagaacttaa

SEQ ID NO: 34168 - protein, 56 aa, Zea mays
  misc_feature: Ceres CLONE 1412586-F
MEETSRIPGYFKNKGILITGATGFLGKILVEKILRVQADVKRIYLPVRAPYAASTR

SEQ ID NO: 34169 - DNA, 734 bp, Zea mays
  misc_feature: Ceres CLONE 1412588-F
  misc_feature (432)..(432): n is a, c, t, g, unknown, or other
  misc_feature (433)..(433): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (447)..(447): n is a, c, t, g, unknown, or other
  misc_feature (449)..(449): n is a, c, t, g, unknown, or other
  misc_feature (461)..(461): n is a, c, t, g, unknown, or other
  misc_feature (494)..(494): n is a, c, t, g, unknown, or other
  misc_feature (509)..(509): n is a, c, t, g, unknown, or other
  misc_feature (516)..(516): n is a, c, t, g, unknown, or other
  misc_feature (597)..(597): n is a, c, t, g, unknown, or other
  misc_feature (653)..(653): n is a, c, t, g, unknown, or other
  misc_feature (691)..(691): n is a, c, t, g, unknown, or other
  misc_feature (711)..(711): n is a, c, t, g, unknown, or other
  misc_feature (722)..(722): n is a, c, t, g, unknown, or other
  misc_feature (725)..(725): n is a, c, t, g, unknown, or other
  misc_feature (729)..(729): n is a, c, t, g, unknown, or other
aagctggagctccccgcggtggcggccgctctagaactagtggatcccccgggctgcaggaattcgcacgagaccattacctagaacatcctaatcgaaaagagaagagggcgggcatcggccagtgggggctcggaggccgagggaggcgatggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggtacccgcgtcgtgctcccttttgtcgccgctgccttcgtgccggtacctcgcgggttctcctcgctcctcaatctccgcggctggggcgcggcgttcgccgccggatctgggcgcgggacggtgccccggaacggcnnatgggcgcgnnngncnctccggttgggngcccgcgcgctcgcggttctcgtcctcgtgtcngtggctctgcttccncttgtcngttccgacgatggacacaaacactgcgagggtgttgtcaggggctgggcggattcctccgcggggcgcgtgatggatgggnacaaactgagcctcagggatttgctcttcttcctccaaattcctaggactggaggncgcacctacttttccttggttctaaaaaagtgtatacnaatgggcaggaatggccccntttctattacnaantaanggtgc

SEQ ID NO: 34170 - DNA, 702 bp, Zea mays
  misc_feature: Ceres CLONE 1412599-F
  misc_feature: Encodes the peptide sequence at SEQ ID NO. 34171
  misc_feature (552)..(552): n is a, c, t, g, unknown, or other
  misc_feature (607)..(607): n is a, c, t, g, unknown, or other
  misc_feature (615)..(615): n is a, c, t, g, unknown, or other
  misc_feature (648)..(648): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (699)..(699): n is a, c, t, g, unknown, or other
gctggagctccccgcggtggcggccgctctagaactagtggatcccccgggctgcaggaattcgcacgagaccattacctagaacatcctaatcaaaaagcaggccgcacacgcaacgcatcactcgtcttcccctcccaaccctccgaaccgaagcaggaaagctagacgatgacgcttacgatcccggacgaggtgcgcgccaaggcggaggtgtacgtggtcgacgcgtcgcggcaggagaagacgcggctgctcctccaggagacgggcctcccgagcgggctgctcccgctgcggaacatcatcgagtgcggctacgtggaggtagacgggcttcgtgtggatccggaagcgccgcacggtggaccactacttcgccgaaggccggccgccacgtgtcctacgggcgccgaggtgtcggcggtgtgcgacaagggccggctcaagaaatcacggtcgtcaggccaaggagatgctgctgtgcccaccctccacgagatctgcgtcgacgacccgcccactgttaagtgcactgcagggccatgcggngggctggttcgcagtctaccccgcagggtcctacgagggcgacgagcctgcgcgnccggaaanccggacgccgtcgtgcccggggaaggggaagangnnnnaaaaaaannnncccccccccccggaaggccggctcttgaagggggnttt

SEQ ID NO: 34171 - protein, 177 aa, Zea mays
  misc_feature: Ceres CLONE 1412599-F
  misc_feature (2)..(150): Pfam Name: DUF538 Pfam Description: Protein of unknown function, DUF538
  misc_feature (146)..(146): Xaa is any aa, unknown, or other
  misc_feature (148)..(148): Xaa is any aa, unknown, or other
  misc_feature (159)..(159): Xaa is any aa, unknown, or other
  misc_feature (160)..(160): Xaa is any aa, unknown, or other
  misc_feature (161)..(161): Xaa is any aa, unknown, or other
  misc_feature (164)..(164): Xaa is any aa, unknown, or other
  misc_feature (165)..(165): Xaa is any aa, unknown, or other
MTLTIPDEVRAKAEVYVVDASRQEKTRLLLQETGLPSGLLPLRNIIECGYVEVDGLRVDPEAPHGGPLLRRRPAATCPTGAEVSAVCDKGRLKKSRSSGQGDAAVPTLHEICVDDPPTVKCTAGPCGGLVRSLPRRVLRGRRACAXGXPDAVVPGEGEXXXKKXXPPPGRPALEGGF

SEQ ID NO: 34172 - DNA, 760 bp, Zea mays
  misc_feature: Ceres CLONE 1412600-F
  misc_feature: Encodes the peptide sequence at SEQ ID NO. 34173
  misc_feature (445)..(445): n is a, c, t, g, unknown, or other
  misc_feature (488)..(488): n is a, c, t, g, unknown, or other
  misc_feature (561)..(561): n is a, c, t, g, unknown, or other
  misc_feature (591)..(591): n is a, c, t, g, unknown, or other
caaagctggagctccccgcggtggcggccgctctagaactagtggatcccccgggctgcaggaattcgcacgagaaccattaacctagaacatcctaatcgaaaaaaactctctcgcatcccactcccggggtctagtctgagggccgttccaatgtgcaaccgggtgaggccactccacgttatctacttgaccagcaggtcccatgaccctgacgagtgggcgcacctcgtcaaggactacacctcgcaatccttgctccgggaagccgccctcgtctacgacaggaacctgccccgccggaagcaccaccaggccctcctccccgtccgccctcaaggccgccgctgcctcctccccgaccgagctaggtctcggcaagtccctccatgcggaggccctcaagtccgcgtttgcccgcgagtctggtcgtcggcaccacaangggtgtcgatgtacctgcaagtgtggcgcactcgccgacgcgncgcaggggcgttcgacgaaatgccgggaccggaacgtcatcagttacaacgcgcttctcgccggtacgccccntgacgaggaacacatggacggtgccctggnttctctgttcggtggcatgcgcttcctggacggacgtcacggtggcgagcttggatccgcgggtttcgcgcagaaggcgacatggcgaagcttttcgaaggtggttcgagcccacgcccgccggtgatgcgaaccgttagcacgtgcaccggggctggtgaaagtctaa

SEQ ID NO: 34173 - protein, 170 aa, Zea mays
  misc_feature: Ceres CLONE 1412600-F
  misc_feature (80)..(80): Xaa is any aa, unknown, or other
  misc_feature (95)..(95): Xaa is any aa, unknown, or other
  misc_feature (119)..(119): Xaa is any aa, unknown, or other
  misc_feature (129)..(129): Xaa is any aa, unknown, or other
MTLTSGRTSSRTTPRNPCSGKPPSSTTGTCPAGSTTRPSSPSALKAAAASSPTELGLGKSLHAEALKSAFARESGRRHHXGCRCTCKCGALADAXQGRSTKCRDRNVISYNALLAGTPXDEEHMDGALXSLFGGMRFLDGRHGGELGSAGFAQKATWRSFSKVVRAHARR

SEQ ID NO: 34174 - DNA, 760 bp, Zea mays
  misc_feature: Ceres CLONE 1412601-F
  misc_feature: Translation starting site: 202
  misc_feature (537)..(537): n is a, c, t, g, unknown, or other
aagctggagctccccgcggtggcggccgctctagaagtagaggatcccccgggctgcaggaattcgcacgagaccattacctaagaacatcctaatcgaaaactcttcgtcgtcctatcttatatatcgcatttcgaaatccccaaacggaggcctcgccactcttccgaaccttgaacaatcaccaccgttattaagaagatgatagcgctgcgctgcaacgggcggcgggtgcgtcgcttcgtggagcggcgattggagattgccgtgcggtcaacccctgcagcgtgcggatgccgacgggcaactgatgggtggtgcgacggcttgaggtcgcgcggcggcgaattctcgccggtgctcgagatgaccaacctgcgcggcaggcgtcggatgggctcttccgcgcgagcccgcgcttacgggcgcttgcaagccacggacggatgttgaccctgaagatattccatttgtgagaaggttcaagttaaatcctcaggacatgttctgccatatgttggcgtctgcttgtttggnagctattctgtttggtaccatcgttggtgtgccctatggcgcacttgaatatctcgcgaatgatcttgctattgctgaaatgctgtcttgcacggggtgcaagtatagcacatcagtgcctggtacaacactaaattcttttactgtgagctctttgagagatagatatgagcgagaatagctttctcctgggtgcctcccactttctctaaggcaattgtgt

SEQ ID NO: 34175 - DNA, 754 bp, Zea mays
  misc_feature: Ceres CLONE 1412605-F
  misc_feature: Encodes the peptide sequence at SEQ ID NO. 34176
  misc_feature (597)..(597): n is a, c, t, g, unknown, or other
  misc_feature (614)..(614): n is a, c, t, g, unknown, or other
  misc_feature (619)..(619): n is a, c, t, g, unknown, or other
ggagctccccgcggtggcggccgctctagaactagtgcatcccccgggctgcaggaattcgcacgagaccattacctagaacatcctaatcgaaaagttcctttcttccccactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggaatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaaggccgtctacttcctccgaccctccgctaacaacgtccagaagctccgcaggcacctcgccatgccgcgcttcgccgagtaccacctattcttctccaggtatattgaaggtcccgcagattcaaatacttgctgactcggatgaancaggaggttgtgcagcnaaggntcaggagttctattggctgattttttgggccattgaccccataccatttcactctcaacatacaaaaataaccacatgtatatgcttccccacagtggtcgaccctccctgggaatggcagggcttctggtgatc

SEQ ID NO: 34176 - protein, 112 aa, Zea mays
  misc_feature: Ceres CLONE 1412605-F
MVLITLVRDYIDRMLHDIPGMKVLVLDPQTVGMVSVVYSQSDLLRKEVFLVETMDNASSSRESMAHLKAVYFLRPSANNVQKLRRHLAMPRFAEYHLFFSRYIEGPADSNTC

SEQ ID NO: 34177 - DNA, 726 bp, Zea mays
  misc_feature: Ceres CLONE 1412606-F
  misc_feature: Encodes the peptide sequence at SEQ ID NO. 34178
  misc_feature (118)..(118): n is a, c, t, g, unknown, or other
  misc_feature (293)..(293): n is a, c, t, g, unknown, or other
  misc_feature (384)..(384): n is a, c, t, g, unknown, or other
  misc_feature (385)..(385): n is a, c, t, g, unknown, or other
  misc_feature (426)..(426): n is a, c, t, g, unknown, or other
  misc_feature (443)..(443): n is a, c, t, g, unknown, or other
tggagctccccgcggtggcggccgctctagaactagtggatcccccgggctgcaggaattcgcacgagaccattacctagaacatcctaatcaaaaatcgctctctcctttgcacccnctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccnagctcatcaacgagaagctcgtggaacaccggatctccactgcgaagcactgcccccactgcggcgagaaaatcgacgcaaaccggatggnngtgggctgccggcaggcgttccagtcgatccactggacagnagctgatcgagcactcnaggcaaaggtaaggatgaagggttcagatctccctctccttcgcgaggtatacccacaaaaatggggggggggggaattggtaccccccccccgaaaatttccgggggggaaagggaaggggcaaaaaaactttttccccgggggggaggattaaaagggggaaaaaaaaagaaggaaaaaaaaaaggggggggccccccccgggggggaaaaagggtggaaaaccccaaaaacccgcccggggggggaagcccccccaaaggggggaaaaaaattttttggg

SEQ ID NO: 34178 - protein, 110 aa, Zea mays
  misc_feature: Ceres CLONE 1412606-F
  misc_feature (10)..(10): Xaa is any aa, unknown, or other
  misc_feature (40)..(40): Xaa is any aa, unknown, or other
  misc_feature (54)..(54): Xaa is any aa, unknown, or other
  misc_feature (60)..(60): Xaa is any aa, unknown, or other
MNRAHSSSSXLINEKLVEHRISTAKHCPHCGEKIDANRMXVGCRQAFQSIHWTXADRALXAKVRMKGSDLPLLREVYPQKWGGGELVPPPRKFPGGKGKGQKNFFPGGED

SEQ ID NO: 34179 - DNA, 695 bp, Zea mays
  misc_feature: Ceres CLONE 1412608-F
  misc_feature: Encodes the peptide sequence at SEQ ID NO. 34180
  misc_feature (316)..(316): n is a, c, t, g, unknown, or other
  misc_feature (389)..(389): n is a, c, t, g, unknown, or other
aaagctggagctccccgcggtggcggccgctctagaactagtggatcccccgggctgcaggaattcgcacgagaccattacctagaacatcctaatcaaaaactgtctcgtcggctcgtcgctccgtagaccccgcgcctccgcctccccgccactcgccggaggctgccgccatcgttatgccatggccgtcatcctctcctccgcggcgccaacgatactgactcgtcccacgcgccctcggaggcagccgaggagcggcctccgcgggggcctcgcgcgcctctcagctgcgctcggcctcgcgcacgcgggncgccggcgccggcgccgcactcgccgcgccgctctcctacgaggagatgctgcgcctctcgtccgactccggnggtgatgttggcgggttcgcgctcccggagctcggcctcgacgggctcgttgacttctgctacgataaccctctcgtcgccgcgggatgtgtagcggcgataggatcggcatgtctccgtagctcgtctatggcaagaagcggctcctccaatcgctactccgccctgtccaccaacgcgggactccaagagtaggctcgaggatcccgccgaggtggtgggtctaaattacggccgatccaggagggacccatcagaccggcgcaccctgtatgcaggacgataaggaacgagtggcggcggcct

SEQ ID NO: 34180 - protein, 73 aa, Zea mays
  misc_feature: Ceres CLONE 1412608-F
MLRLSSDSGGDVGGFALPELGLDGLVDFCYDNPLVAAGCVAAIGSACLRSSSMARSGSSNRYSALSTNAGLQE

SEQ ID NO: 34181 - DNA, 701 bp, Zea mays
  misc_feature: Ceres CLONE 1412610-F
  misc_feature: Encodes the peptide sequence at SEQ ID NO. 34182
  misc_feature (677)..(677): n is a, c, t, g, unknown, or other
aagctggagctccccgcggtggcggccgctctagaactagtggatcccccgggctgcaggaattcgcacgagaccattacctagaacatcctaatcaaaaaagacaacacacgaacaccgcaccgcaacgtaaccggctaggggaagagctctttccttcagctgtgccgcgcacaacgcacgtaacgctggattggtttgcatcgcccccgccaataaagacgctgtcgtgagcggcctgagcggtcgctaagcagcagcaggcgaacgacatgccgagagatagcgcgctctccgggtcggggaacctcaagcacgtcaagctggggtaccagtacctgatgaaccacttcctgacgctgctgctggtgccggtgatggccgccacggcgctggagctggcgcgcctcgggcccggcgagctgctctcgctgtggcgctcgctggagctggacctggtccacatcctctgctcggcgttcctggtcttcttcgccgcgaccgtgtacgtgatgtcgcggtccaaggcggagtacctggtggactacgcctgctacaagccccccgccagctgccgagtgcccttcgccaccttcatggagcacacgcgcctcatcatcgacgacgacaagagcgtgcgctttcagaccaggatcctggagcgctcggtgctcggngaggacacgtgcctcccgaccgcc

SEQ ID NO: 34182 - protein, 143 aa, Zea mays
  misc_feature: Ceres CLONE 1412610-F
  misc_feature: SWISSPROT Homolog: EC 2.3.1.119 Icosanoyl-CoA synthase
MPRDSALSGSGNLKHVKLGYQYLMNHFLTLLLVPVMAATALELARLGPGELLSLWRSLELDLVHILCSAFLVFFAATVYVMSRSKAEYLVDYACYKPPASCRVPFATFMEHTRLIIDDDKSVRFQTRILERSVLGEDTCLPTA

SEQ ID NO: 34183 - DNA, 740 bp, Zea mays
  misc_feature: Ceres CLONE 1412611-F
  misc_feature (437)..(437): n is a, c, t, g, unknown, or other
  misc_feature (513)..(513): n is a, c, t, g, unknown, or other
  misc_feature (598)..(598): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggctgtgtacggactggggatcggggatccctccggaccgggataggatttcgctttttgctgggcgaggaagggagcttcccccgatagatgtctcacctccgataccctggatttcgtccgtggcgagtggctaccgcttctgctccttttgtgacagctgaatctttgntggttcgaaggcgattgacttgggtcaactgacgcggtgacgcccaatgagctcccacgctcccaccatcggcggngtcttcatcccccaggcaagctttggggacgttggactcaccccgggtgcgtggcagccgccagcacctatggctcagcccgaancaggcccgcggtgatgacccagaggtcaggctggntggtcggtttgcttggaatcagggactgtggatgctttcgctgccggtaccagtaacgggatcaggatctttaactgtgagcctttcaggagacttttcggagggat

SEQ ID NO: 34184 - DNA, 736 bp, Zea mays
  misc_feature: Ceres CLONE 1412612-F
  misc_feature: Encodes the peptide sequence at SEQ ID NO. 34185
aaagctggagctccccgcggtggcggccgctctagaactagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggcggctccatccgccctctctccccagaggaagccgtagctgagagcgactgcaaggtttccagaatatacggggtggtaggcaccataagattgctcgctggaagctatgtactcgttatcacttctcagaaagatgctggctcttatctgggctcccctgtgtaccaagtgaactcaatgaaattcttatgctgcaacgaggctatcaagcacttgactccacaggaaagaagggatgaggcatacttcatgtctctcctgagaattgcagaaactaacttgtggattgtattattcataccgacagggatttgacactaaaacttgcagaggggcatccaagttgcctttgcagggaaggtacataaaccacttatgggaacaggctggaaccccaccggttttgttgggaaaaaaaatatttg

SEQ ID NO: 34185 - protein, 156 aa, Zea mays
  misc_feature: Ceres CLONE 1412612-F
MANADADEAPLLSVEHLRPGSCSRELELREFRDRYVIRSLDGAAAFAVLRSGGSIRPLSPEEAVAESDCKVSRIYGVVGTIRLLAGSYVLVITSQKDAGSYLGSPVYQVNSMKFLCCNEAIKHLTPQERRDEAYFMSLLRIAETNLWIVLFIPTGI

SEQ ID NO: 34186 - DNA, 753 bp, Zea mays
  misc_feature: Ceres CLONE 1412614-F
  misc_feature: Encodes the peptide sequence at SEQ ID NO. 34187
  misc_feature (365)..(365): n is a, c, t, g, unknown, or other
  misc_feature (366)..(366): n is a, c, t, g, unknown, or other
  misc_feature (372)..(372): n is a, c, t, g, unknown, or other
  misc_feature (373)..(373): n is a, c, t, g, unknown, or other
  misc_feature (380)..(380): n is a, c, t, g, unknown, or other
aaagctggagctccccgcggtggcggccgctctagaactagtggatcccccgggctgcaggaattcgcacgagaccattacctagaacatcctaatcgaaaaagcctacacgcccccgcctcctgccctctgtccacatcctcgcctctccccactagttcgctcgcgtgatggtggtgcgggagcagcggaacaagggttcgtcgtcggccaccctgtgacaccccgcccacgcccccgcggcggaacctgcaaacccggaggccggagctccgacttcgtcggccatcgaccgcgtctgatcggcgctgggacctgccgtccggacgaaatcggtcagcatgacggggcccaatgagaaggcnngcgcgnnagggcgngggtggcgagaggcgcaagtacccgatccacgtggaggactacgagctgtacgaggagatcggggcagggcgtcagcgccatcgtgtaccgcgcactctgcaagcactcgacgagatcgtcgccgccaagggggtcgacttcaaggggaccaacgggacctgaacaaaatcgttcggggaacctcaaacaaggatttggaaaaccacccctaacgttggaaggggcattgttcttttgaaaaaaacaaaggttatgggggggttttgcccaaaaagggtggggggggcccggcctccccataaagaaaaccggggccctccatggttgtttgggggaccccttttccgggaaaatatctttgggaagtgtgaa

SEQ ID NO: 34187 - protein, 62 aa, Zea mays
  misc_feature: Ceres CLONE 1412614-F
  misc_feature (4)..(4): Xaa is any aa, unknown, or other
  misc_feature (7)..(7): Xaa is any aa, unknown, or other
  misc_feature (9)..(9): Xaa is any aa, unknown, or other
MRRXARXGXGGERRKYPIHVEDYELYEEIGAGRQRHRVPRTLQALDEIVAAKGVDFKGTNGT

SEQ ID NO: 34188 - DNA, 746 bp, Zea mays
  misc_feature: Ceres CLONE 1412615-F
caaagctggagctccccgcggtggcggccgctctagaactaagtggatcccccgggctgcaggaattcgcacgagaccattacctaagaacatcctaatcgaaaaacgcacaccgcgacccaatctagagccagtacgtgtgaagtatcacgcacgctgcttgcccgcttacgatgagatgacggacaggtcgtccgcctgccttttaacgttggaataatgacggcgactacgacgactggcgccggtggccgtcggctgcatcctcgtggtctggctgggggatctgtttctgctcgtcggtgtgggggctgctcgtcggacgtgtgacccaggaaggctcagccgccgccggagcagcgccagcggagtctccgatgaccacgactaggactgtggaggaagtgaatacttgaggaggaggaggacgacaagaaggatctcgaggcaatgtgacgggccgaggaggaggagcgccgcgagcagaaggccgagacgaatactcgccgccgacggggacggtccaagcgccgccgcgacccgagtagcgaggatgagtactccgaggagctagagctgcaaacgtaggatccccgtcgtggaggagatctcggacgcgtcgcccgtacctgtaaagtactggccccaagatctctggccacgggctgtaagcagaagaaggtctatggttccttccgactaccgagggcacatttttccatctggcaggacccccttccttctcc

SEQ ID NO: 34189 - DNA, 742 bp, Zea mays
  misc_feature: Ceres CLONE 1412616-F
  misc_feature: Translation starting site: 177
  misc_feature: SWISSPROT Homolog: EC 2.7.6.1 Ribose-phosphate diphosphokinase
  misc_feature (1)..(1): n is a, c, t, g, unknown, or other
  misc_feature (238)..(238): n is a, c, t, g, unknown, or other
  misc_feature (242)..(242): n is a, c, t, g, unknown, or other
  misc_feature (561)..(561): n is a, c, t, g, unknown, or other
  misc_feature (645)..(645): n is a, c, t, g, unknown, or other
naaagctggagctccccgcggtggcggccgctctagaactagtggatcccccgggctgcaggaattcgcacgagaccattacctagaacatcctaatcgaaaaatagaccggattaaaaccctaggccctagccaccgcccaccgtcgcctcagtaaatcctcctcccgtttcaccatgccgccctgctgctcccccaccacctccgccgtcaccgctgcggcggcatctcccggcgntcgncgcagcgggggcctcctgtgccgctcgcgcccagtccccgacgtcgtgaattgtaaaaagattgattctctgaggtcaatcaatgaagcaccaccttgtattccggtgtccaacaggtcactattgactcctgtaaccttgccagtttgccggcatccaaacatgacgaacgacacgaggctgcgcatcttctcaggcacagccaatccttccctttcccaggagatagcaagttacttggagctagaacttgggaagataaccataaagaggtttgctgatggtgaaatatatgttcagttgcaagaaagtgtacggngctgtgatgttttccttgtgcaaccgtcgtgtcctccagcaaatgaaatcttatggagcttctgatcatgattgatgcctgtangagagcatctgctaagatatcactgcagttatcccttattttgggtatgcaagggctgacaggaagtcccagggcagggaatctatagctgcaaaat

SEQ ID NO: 34190 - DNA, 754 bp, Zea mays
  misc_feature: Ceres CLONE 1412618-F
  misc_feature: Encodes the peptide sequence at SEQ ID NO. 34191
  misc_feature (1)..(1): n is a, c, t, g, unknown, or other
natagctggagctccccgcggtggcggccgctctagaactagtggatcccccgggctgcaggaattcgcacgagaccattacctagaacatcctaatcaaaaaaccggtcgcgaaccctcctcctccagccacgcctcgaaacggcgtcggggcctgcgcgacgagtccatggctgatcgcttcattcccaatgactttcctgacttcgtcgccgaggctgaggcctccgacggcggaggggcaccgccccgcagggcatcggggtctgctctcgcttccgtacaccaggctctccgaccacttcgtccgcggcgcgcgccgcctcaaggacaaggcgcctgaggagacgtgtgtgaaaggcggacgaaaggcgacggactacacgctctacacgggctctctcgggacagagctggtgctgttcaagtccttccaggtcactggagaccgcggtgacctcaccctcgtcgctgatatcgtccgctagtgagatgagaaatctcggcagctgccgctcttgacttcatatgccgaaaggccagctagtctgtcccgttgtattgaagatcgccgcagattgaatacttgctgtctcggaagatcaggagctggtgcactatgatgagagagcctatgcggatatagtgccgcatgaaccgcttgcaatttcactctcaacatactaaagtaccagcttgtatatgctcccaacatgtgaccgaccactcctggcacgctacggcttctttagat

SEQ ID NO: 34191 - protein, 98 aa, Zea mays
  misc_feature: Ceres CLONE 1412618-F
MTFLTSSPRLRPPTAEGHRPAGHRGLLSLPYTRLSDHFVRGARRLKDKAPEETCVKGGRKATDYTLYTGSLGTELVLFKSFQVTGDRGDLTLVADIVR

SEQ ID NO: 34192 - DNA, 794 bp, Zea mays
  misc_feature: Ceres CLONE 1412619-F
  misc_feature: Encodes the peptide sequence at SEQ ID NO. 34193
  misc_feature (288)..(288): n is a, c, t, g, unknown, or other
  misc_feature (365)..(365): n is a, c, t, g, unknown, or other
  misc_feature (366)..(366): n is a, c, t, g, unknown, or other
  misc_feature (374)..(374): n is a, c, t, g, unknown, or other
aaagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggncgccgcctccgcgtcgacgccatcgccgagatcgacctctacccgctcgagccctggggactccctcccctctccgnnatcgaagncgggacgcccaggggtacttcctcgcccgtctcgaccgcaagtcgccggcgctggcgccgggggcccgggcggcccccggaaaggggcccacggggctacgccgagggggaactggaaaaacccggtcaaggcccggaagggggccccacccggggaaggcccttcggataaaaaaaaaccctcttcctccccccccgggaggggcctctagagggaaaaggaacaaagttggggtttgaaaaaaaccccccccttctgggggaagagggcccccggagggtgggggggggggggttaaaaaaacttcccaaaaggggggggggagaaccaaaaagggggggggggggggggggcccccctttcgtgaaaaaaaggtggagaacaatgttctcctctctttggaagagccgcccccaccg

SEQ ID NO: 34193 - protein, 133 aa, Zea mays
  misc_feature: Ceres CLONE 1412619-F
  misc_feature (24)..(132): Pfam Name: NAM Pfam Description: No apical meristem (NAM) protein
  misc_feature (74)..(74): Xaa is any aa, unknown, or other
  misc_feature (77)..(77): Xaa is any aa, unknown, or other
MSLSPLDSSSPPAAAAAAATEVPLAPGFRFHPTDEELVSYYLRRRVLGRRLRVDAIAEIDLYPLEPWGLPPLSXIEXGTPRGTSSPVSTASRRRWRRGPGRPPERGPRGYAEGELEKPGQGPEGGPTRGRPFG

SEQ ID NO: 34194 - DNA, 672 bp, Zea mays
  misc_feature: Ceres CLONE 1412620-F
  misc_feature: Encodes the peptide sequence at SEQ ID NO. 34195
  misc_feature (52)..(52): n is a, c, t, g, unknown, or other
  misc_feature (672)..(672): n is a, c, t, g, unknown, or other
atagctggagctcaccgcggtggcggccgctctagaactagtggatcccccngggctgcaggaattcgcacgagaccattacctagaacatcctaatcgaaaaatttcaaacgcatctcccccctcacctcgctggcctacgtacgtgtacgtctctctctctccgccgcgacccccccacaagcggcgccggcgcccgcgctgcagctaaaccaaaccctaagccacggccaccgccctacgccgcgggctctccgcgatgcgccggcgcgcggaggcgatcgcgagggccgtggtcgagttcctcgacgccgtcatcctggcctgtctccgctcgtgcttcggcgcgcgcccccgccgcggctccggccgccgagatgcgctcgtgcgcggtgatcgggccgcggaggtcatctgggatgaggaaggcttagtaagggacggacgatttcatgaggatttggctgacgggtgtggaatcgatgaggagctcacacgcgacgcaagttacctgaagctatgcggcactatctctgaaaccccagctgaactacgcaatgagcaatcgtatgaaaaccatttggaaactacttaatgagtgggatagcaagctcacgtatggaccaccggcaatgggcaaatggcttgtttgaagctaattcatcacagggn

SEQ ID NO: 34195 - protein, 111 aa, Zea mays
  misc_feature: Ceres CLONE 1412620-F
MRRRAEAIARAVVEFLDAVILACLRSCFGARPRRGSGRRDALVRGDRAAEVIWDEEGLVRDGRFHEDLADGCGIDEELTRDASYLKLCGTISETPAELRNEQSYENHLETT

SEQ ID NO: 34196 - DNA, 737 bp, Zea mays
  misc_feature: Ceres CLONE 1412625-F
  misc_feature: Encodes the peptide sequence at SEQ ID NO. 34197
  misc_feature (397)..(397): n is a, c, t, g, unknown, or other
  misc_feature (672)..(672): n is a, c, t, g, unknown, or other
  misc_feature (719)..(719): n is a, c, t, g, unknown, or other
caaagctggagctccccgcggtggcggccgctctagaactagtggatcccccgggctgcaggaattcgcacgagaccattacctagaacatcctaatcgaaaagaaaaggctagccaagaaaacgactgggcgcacgaggcttctgtgttctgtgacttctgtccctatccacacgaccccgacattccatgggcgactccggcggaccccaccaccaccgcccttcgccgccgcctctgctggacgccggcaagcgacggcgcatccccaacgtccgcctcgctggctccgtcccgctcccttcccacctgccccacccgcgccgcgtccccattgcccccgccaccaggtcccgcaaacccctccaacttcagcataacagcaaccagcatgacncacccctccgcggagccacccaataccctcctaaaacccttcgtcgacaggggggcgacgacgtcgtcttgggccgccgcttttccccgcaaggtcagggccccggcttgagggacctgggtggtggggagctactgccacgatgtgctaattccggggcggcgcataagtgggggagaacgctcgggcggggctggcggccttcgtgtccaacgtgcttcgacgccgcttcgccccagggcgccgcgctcaacgagacatcccccctttgtcgntgtgggccaaggtgggtcacgacttcatctacgccggggcggccggnggtccgcgcggaatccgc

SEQ ID NO: 34197 - protein, 182 aa, Zea mays
  misc_feature: Ceres CLONE 1412625-F
  misc_feature (70)..(70): Xaa is any aa, unknown, or other
  misc_feature (177)..(177): Xaa is any aa, unknown, or other
MGDSGGPHHHRPSPPPLLDAGKRRRIPNVRLAGSVPLPSHLPHPRRVPIAPATRSRKPLQLQHNSNQHDXPLRGATQYPPKTLRRQGGDDVVLGRRFSPQGQGPGLRDLGGGELLPRCANSGAAHKWGRTLGRGWRPSCPTCFDAASPQGAALNETSPLCRCGPRWVTTSSTPGRPXVRAES

SEQ ID NO: 34198 - DNA, 739 bp, Zea mays
  misc_feature: Ceres CLONE 1412626-F
  misc_feature: Encodes the peptide sequence at SEQ ID NO. 34199
  misc_feature (1)..(1): n is a, c, t, g, unknown, or other
  misc_feature (364)..(364): n is a, c, t, g, unknown, or other
  misc_feature (394)..(394): n is a, c, t, g, unknown, or other
naaagctggagctccccgcggtggcggccgctctagaactagtggatcccccgggctgcaggaattcgcacgagaccattacctagaacatcctaatcgaaaagaactcctaccctcattatcgcctgtaagccagatgaaccacatctcggcgagaacattcggagcccgctaacacacgccctatcgattgccatgagccatgccccatgcccaagcccgacctgagactgctcgagcacctacacgccgccgttctgatccttcccgccccggccggtggctggcacgacaaggttctgcgctaccgagagcgccccgaccgactgactcacgccggggcctccttcctccgcgcgtgggnggacgtgtgccagtcgaccctcgcgggagncgcgtacatgcagccagtgagctacctgctggcagaacgacacgttcatcgtcaccatgcacatgcgggacgcgaccctcatcggcgcacgtacgggcacctcatcacgagctactgtggagcaggtccccatggtacgcgaaccgcgccaagaaaatcgcaccccgcttcttttcagggtgggaaagggtacgtgaactcggaggcctaggccccccgggaaaaggttctgggccgaaatttggcccaccagacgggccccccgaaccaggcaaggtcttactcaggggatccgggaaggggccctggggacccgcacttggccccctctttcgcccccgagtg

SEQ ID NO: 34199 - protein, 131 aa, Zea mays
  misc_feature: Ceres CLONE 1412626-F
  misc_feature (52)..(52): Xaa is any aa, unknown, or other
  misc_feature (62)..(62): Xaa is any aa, unknown, or other
MPKPDLRLLEHLHAAVLILPAPAGGWHDKVLRYRERPDRLTHAGASFLRAWXDVCQSTLAGXAYMQPVSYLLAERHVHRHHAHAGRDPHRRTYGHLITSYCGAGPHGTRTAPRKSHPASFQGGKGYVNSEA

SEQ ID NO: 34200 - DNA, 760 bp, Zea mays
  misc_feature: Ceres CLONE 1412628-F
  misc_feature: Translation starting site: 284
  misc_feature (497)..(497): n is a, c, t, g, unknown, or other
  misc_feature (580)..(580): n is a, c, t, g, unknown, or other
  misc_feature (678)..(678): n is a, c, t, g, unknown, or other
  misc_feature (745)..(745): n is a, c, t, g, unknown, or other
  misc_feature (750)..(750): n is a, c, t, g, unknown, or other
caaagctggagctccccgcggtggcggccgctctagaactagtggatcccccgggctgcaggaattcgcacgagaccattacctagaacatcctaatcgaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtatcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccagganctccttgggatttttcagaacgagtgggatgctctcatgctttctaattttgctttggagcagcagctacacacagcaagacnagaacttagtcatgcactctaccagcatggacgctgcctgggcgtgtatagccagggtgaagaaggaaagagatgaggctagagcacttttggctcangctgagagaagattccagcatcagttgcaggagtgcttccctgcagctggtgtttcaatggaaaagnagcantggaagatga

SEQ ID NO: 34201 - DNA, 719 bp, Zea mays
  misc_feature: Ceres CLONE 1412631-F
  misc_feature: Encodes the peptide sequence at SEQ ID NO. 34202
  misc_feature (560)..(560): n is a, c, t, g, unknown, or other
  misc_feature (561)..(561): n is a, c, t, g, unknown, or other
  misc_feature (632)..(632): n is a, c, t, g, unknown, or other
  misc_feature (639)..(639): n is a, c, t, g, unknown, or other
  misc_feature (694)..(694): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccggcgtccctgggcccgcgcgaggcccgcgcgctccgggaccgcctcgcggaggagctcacccaggtgcgcgccctcctctcccgcatcgacacctggcagcagcagggcccgccgcccgcggggctccgcggcgaggtgcggaagcgnntgcggcagatcctcaccaggctgcgcaggacaagcggagcgtgtggttcacgcgcccgtcgaggtggagcngctcggnctcacgtacacgccgtcatcagcgcccatggactcggaccgtcaaggaggctcgnncgcgggagtacgctcgcacgacac

SEQ ID NO: 34202 - protein, 165 aa, Zea mays
  misc_feature: Ceres CLONE 1412631-F
  misc_feature (113)..(113): Xaa is any aa, unknown, or other
  misc_feature (139)..(139): Xaa is any aa, unknown, or other
  misc_feature (157)..(157): Xaa is any aa, unknown, or other
MASALLAGQGGARHHGWGETRAPLAPIPPNPNPSQPHPRADGSKSKPRAAASSPAAGYVTFRPASLGPREARALRDRLAEELTQVRALLSRIDTWQQQGPPPAGLRGEVRKRXRQILTRLRRTSGACGSRARRGGAARXHVHAVISAHGLGPSRRLXRGSTLARH

SEQ ID NO: 34203 - DNA, 798 bp, Zea mays
  misc_feature: Ceres CLONE 1412632-F
  misc_feature (53)..(53): n is a, c, t, g, unknown, or other
  misc_feature (61)..(61): n is a, c, t, g, unknown, or other
  misc_feature (62)..(62): n is a, c, t, g, unknown, or other
  misc_feature (390)..(390): n is a, c, t, g, unknown, or other
  misc_feature (417)..(417): n is a, c, t, g, unknown, or other
catagctggagctccccgcggtggcggccgctctagaactagtggatcccccngggctggnncaggaattcgcacgagaccattacctagaacatcctaatcgaaaaccccaaccccgttcttctccctccgtccgaccgtccctcgacagtgtcgaggcgcaacctagcagccgcccacgcggcgcgacatccactggcgcaagcgcaatccgcaagggccccccggcgcgccgccagcctcctggatcggccgcccccgcggataaccaggggcgtaaaggccggtcagcctgccacacctcatcctgccagccagtcggaaacgatcgtatgagggaagccgcagacgaccgctgactccgatcccacctctagtgacccccaggangacggatccttctcgtctgaccacgangttcattttgaaggcctactttcactcaaccattaagtttttttctggcagccttaactttcccctggcccgcctttacggggttttgcacaggcccgggaggggaaaaaaccggggaaccccccgaattttaaattttttttttccctttttccgcccaaaaaggttcccaatttggaaaaaacccgctgggggtgccccccccccttgggaaacccgagggggggggcccccccccggggggaaaatttcgcgcgaaaaaaaaaaaaaaaaaaaggggggggggtgttttttttccgcggaagggaactctgggggaaaataacttattttcccccccccctttttttcccctttactaccctattttgttgggggaat

SEQ ID NO: 34204 - DNA, 758 bp, Zea mays
  misc_feature: Ceres CLONE 1412635-F
  misc_feature: Encodes the peptide sequence at SEQ ID NO. 34205
  misc_feature (481)..(481): n is a, c, t, g, unknown, or other
  misc_feature (515)..(515): n is a, c, t, g, unknown, or other
  misc_feature (597)..(597): n is a, c, t, g, unknown, or other
  misc_feature (601)..(601): n is a, c, t, g, unknown, or other
  misc_feature (658)..(658): n is a, c, t, g, unknown, or other
catagctggagctccccgcggtggcggccgctctagaactagtggatcccccgggctgcaggaattcgcacgagaccattacctagaacatcctaatcgaaaaatttcccaccttcccaaacgccacttaaaagagaaaggagagcatcgcagtggcacacgcgcaatggaaggctcgccggtgacgcgcctcccggaggctaactccctccccgacggcttcgttcccgactccgagagccctggcacggacgcgacgtttcccttctccgcgcccatcgttgatgatgcgctcaactccgatatccccgccgcgaccaacccaggcggcgaggaaaccctaaacgatccccccctccctgcgtccagcgccgaagatgcctcctcggccgccgctgctgaagccttgggcacactttctctggacgctgccgccgagccagaacgcgctctagaggagaacggacccaccggcgctgcnagaagtgaagcatccttgaagatttgtgcatcanagctagtgggcgcctcaactgctcaaaaagggagcgttgaggcgaaccgtagggttgggaaacgcgaacacgcttgagaagnaccnaaaagttgtttgaactggcccagcataaccataaaggtggtgcaaaaagggatgccncccttgggagttaaagaaaaactagaatccctttgggaggggaggttcagggtcaaaacaaatggttaaggaagaaggcccaagggggggccaaggaagg

SEQ ID NO: 34205 - protein, 141 aa, Zea mays
  misc_feature: Ceres CLONE 1412635-F
  misc_feature (117)..(117): Xaa is any aa, unknown, or other
MEGSPVTRLPEANSLPDGFVPDSESPGTDATFPFSAPIVDDALNSDIPAATNPGGEETLNDPPLPASSAEDASSAAAAEALGTLSLDAAAEPERALEENGPTGAARSEASLKICASXLVGASTAQKGSVEANRRVGKREHA

SEQ ID NO: 34206 - DNA, 718 bp, Zea mays
  misc_feature: Ceres CLONE 1412640-F
  misc_feature (245)..(245): n is a, c, t, g, unknown, or other
  misc_feature (287)..(287): n is a, c, t, g, unknown, or other
  misc_feature (302)..(302): n is a, c, t, g, unknown, or other
  misc_feature (339)..(339): n is a, c, t, g, unknown, or other
  misc_feature (356)..(356): n is a, c, t, g, unknown, or other
  misc_feature (359)..(359): n is a, c, t, g, unknown, or other
acaagctggagctccccgcggtggcggccgctctagaactagtggatcccccgggctgcaggaattcgcacgagaccattacctaagaacatcctaatcgaaaaaccgccccaggccccccgatctcctcctcccacttccgatcgcccgaccgatcgccgagcttccctgttccctccccgccccccgcgacgccttggagccgccgcacgccgagcaggccgtcgccgtcgcacgctgagcangccgtcgccgctgtagcagcaggaaggagaggtggcactggncagcccggcaccggnctccgaagtgctgtctgcttaacgttttttgtttcgntcagatctattgcccgnacnagccggactgtggctactacctcggaacgaagttgcgacgggggcttcctagaatcggagaaaactcctttcgaagcaaagggccgaacccccctcctcccccccctttttccgaaacctgggatttttttgtcggtgggattccaaaacccgggaaattcgaatcccccggcgaggattgggcctggcccaaaaaaaaacaattggtttttcccgggaaaaacgggaaagggttttgtcctttttattaatcgggggaaaaaaaacggggttttattttaggaaacctggttgcgtgttcctctggggggggggggaaaaaaggggaaaacccgttggggtgtctttttgttgacaca

SEQ ID NO: 34207 - DNA, 770 bp, Zea mays
  misc_feature: Ceres CLONE 1412643-F
  misc_feature: Translation starting site: 177
  misc_feature: Pfam Name: Peptidase_M16 Pfam Description: Insulinase (Peptidase family M16)
  misc_feature (599)..(599): n is a, c, t, g, unknown, or other
  misc_feature (718)..(718): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
acaagctggagctccccgcggtggcggccgctctagaacaagtggatcccccgggctgcaggaattcgcacgagaccattacctaaaacatcctaatcgaaaaacgcgcgcaccgtccctcaccgccggcctctgctcctcttccgccgccgcaggatctcgtatcgccggagaccatgtaccgcgccgccgggagccacctccgctccctcaagcatcatggtgcttctaggcttgccagtacaagtgttgcgaagcagtcctcaggtggtctgttcagctggcttcttggtggaaaatcaagcgaactccctccccttgatgttccactcccaggcattagcattccctcacctctaccagattttgtagagccatctaagacaaaagtcactactcttccaaatggcgtcaagatcgcctcggagacatcatcgagcccacagcatcttgtgggtctgtacatttgactgtggttccatttacgaaacacctgcttcatctggagtatcacatctgtttggagagaatggccttcaagagcacagtgaatcggactcactttacgggttaagttcgtgaggtagaagccatttggnaggaaatgtctctgcatccagcttcccgtgaacaaatgagctatacctatgaatgcattgaagagcttacacagaaaaaaaggggttgaagttctcatttgacagggtgagggatcagnaattcccccccattgggaggtcaaagagcagctccagagaccccnnnnnnnn

SEQ ID NO: 34208 - DNA, 724 bp, Zea mays
  misc_feature: Ceres CLONE 1412644-F
  misc_feature: Encodes the peptide sequence at SEQ ID NO. 34209
  misc_feature (633)..(633): n is a, c, t, g, unknown, or other
  misc_feature (669)..(669): n is a, c, t, g, unknown, or other
  misc_feature (696)..(696): n is a, c, t, g, unknown, or other
  misc_feature (697)..(697): n is a, c, t, g, unknown, or other
  misc_feature (700)..(700): n is a, c, t, g, unknown, or other
caaagctggagctccccgcggtggcggccgctctagaactagtggatcccccgggctgcaggaattcgcacgagaccattacctagaacatcctaatcgaaaactcgaaggcccagcagacaacagcccctctttcttctcagccatgtcggaggacgaagcgaacgctgctgcccgccggcagagggaaagaactggcggcggaaggggaagcacgacaagcccaagccgtgggacgaggaccccaacatcgaccgctggaagatcgacaagttcgaccctgcctggaacgagggcggcatgctcgaagtcagctccttctccaccctctttccccagtaccgagagaagtacctacaggaggcgtggccggtcgtgaagggcgcattgaaggagtacgggatctcgtgcgagctcaatttggtggagggatccatgactttgtcgacgaccagaaagacaagggatcccttcgctattatcaaggccagggaactaattaagcttttgtccaggagcgtccctgcacctcaggcaatcaaaattcttgatgatgagatgaactgcgatattattaaagattgggtggtcttgtgagaaataaagggagcggtttggttaaaaggagggaancggcttttaaggccctaacttgtctacactcaaggnctatgaagattttgactggctgctacnntcntagtgcagggaaatactggtgcac

SEQ ID NO: 34209 - protein, 98 aa, Zea mays
  misc_feature: Ceres CLONE 1412644-F
MLEVSSFSTLFPQYREKYLQEAWPVVKGALKEYGISCELNLVEGSMTLSTTRKTRDPFAIIKARELIKLLSRSVPAPQAIKILDDEMNCDIIKDWVVL

SEQ ID NO: 34210 - DNA, 678 bp, Zea mays
  misc_feature: Ceres CLONE 1412646-F
  misc_feature: Encodes the peptide sequence at SEQ ID NO. 34211
  misc_feature (312)..(312): n is a, c, t, g, unknown, or other
  misc_feature (391)..(391): n is a, c, t, g, unknown, or other
  misc_feature (419)..(419): n is a, c, t, g, unknown, or other
  misc_feature (431)..(431): n is a, c, t, g, unknown, or other
  misc_feature (492)..(492): n is a, c, t, g, unknown, or other
caaagctggagctccccgcggtggcggccgctctagaactagtggatcccccgggctgcaggaattcgcacgagaccattacctagaacatcctaatcgaaaaaaaaaccccccctgccccagacgtcgcgcgcatgaaatgaaaccctagtgagtagtgaccctgtccggatcactgcgtggcgccgccatggcaccctccgctctggcctccctcccggcgccgctccggtcactgcggctcaagacgaagcagcaggagctactgctccgcgtctcggcgctggcgctcatctacgttctcgccttcgncgtccgcctcttctccgtcctccgctacgagtctatgatccacgagttcgacccctaacttcattttacgcacacgctnctccttcacgagaacgcctttagcgagntctggaactggntcgattccgagagctgtacccgctctgggcgcgtcctccggggggactctccttcccgggnctccatgtggacgcgcgggttgggtcaccggcttcctcgggggttttcccttggtgtcacattccgggggggctggggtcttaccgggccttttctcgcggccaaaccactctcgtcgcctacgctttgggccggagactggaatccccgggggggggtttgtttcccccgggttatggccacggg

SEQ ID NO: 34211 - protein, 59 aa, Zea mays
  misc_feature: Ceres CLONE 1412646-F
  misc_feature: SWISSPROT Homolog: EC 2.4.1.119 Dolichyl-diphosphooligosaccharide--protein glycotransferase
  misc_feature (41)..(41): Xaa is any aa, unknown, or other
MAPSALASLPAPLRSLRLKTKQQELLLRVSALALIYVLAFXVRLFSVLRYESMIHEFDP

SEQ ID NO: 34212 - DNA, 748 bp, Zea mays
  misc_feature: Ceres CLONE 1412647-F
  misc_feature: Encodes the peptide sequence at SEQ ID NO. 34213
aaagctggagctccccgcggtggcggccgctctagaactagtggatcccccgggctgcaggaattcgcacgagaccattacctagaacatcctaatcgaaaactcgaagggccagcagacaacagcccctctttcttctcagccatgtcggaggacgaagcgaacgctgctgcccgccggcagagggaaagaactggcggcggaaggggaagcacgacaagcccaagccgtgggacgaggaccccaacatcgaccgctggaagatcgacaagttcgaccctgcctggaacgagggcggcatgctcgaagtcagctccttctccaccctctttccccaggaccgagagaaggacctacaggaggcgtggccggtcgcgaagggcgcattgaaggagtacgggatctcgtgcgagctcaatttggtggagggatccatgactttgtcgacgaccagaaagacaaggggtcccttcgctattatcaaggccagggaactaattaagcttttgtccaggagcgtccctgcacctcaggctatcagaattcttgatgatgacatgaactgcgatattattaagatgtgagatgctgtgagaaataatgagcgtcttagtaagaggagggcacggctgttacgccctagcttgtctacactcacggctattgagatgttgactggctgctacatcttagtgcagggaaaaactggtgcatgcatggccaactataaggtgagggggactgaaca

SEQ ID NO: 34213 - protein, 94 aa, Zea mays
  misc_feature: Ceres CLONE 1412647-F
MLEVSSFSTLFPQDREKDLQEAWPVAKGALKEYGISCELNLVEGSMTLSTTRKTRGPFAIIKARELIKLLSRSVPAPQAIRILDDDMNCDIIKM

SEQ ID NO: 34214 - DNA, 780 bp, Zea mays
  misc_feature: Ceres CLONE 1412649-F
  misc_feature: Encodes the peptide sequence at SEQ ID NO. 34215
  misc_feature (84)..(84): n is a, c, t, g, unknown, or other
  misc_feature (350)..(350): n is a, c, t, g, unknown, or other
  misc_feature (355)..(355): n is a, c, t, g, unknown, or other
  misc_feature (379)..(379): n is a, c, t, g, unknown, or other
acaagctggagctccccgcggtggcggccgctctagaactagtggatcccccgggctgcaggaattcgcacgagaccattaccntagaacatcctaatcaaaactcgcgttccatttgcttcggctcatctcagatcaagctagcgcacctgacacccaccacctccctcccagatccaccaccccagccatggccaccgcctttgactccccgacctcctcccccgccgccgcgcccttccacgacgaccctttcctccatttcgacggctcggcccccgccgccgccgacggcttcccggcctcccccggacgctacgcgccctcccccctcggcatgccccactccnacggngaccctcacgacggaccttttcgncgcaccctgtgaactccaacggggggcccatcctttcgcccgcccacgaaaatggcccgcgaggagggatccctggtccgggaggggggccaaaaaaggtttttcccttggggaaaaaaaaaaaaagggaaaggggcttggggcccaatccttcgttgggggaaaaagtttaaaaaaacttttggtgaaaaaaaaaactcttgggtaaaaaaaagagggccaaacggggggggggaaaatttttttcaaaaaacccaaaaaaaccccgggggggggggaaaaaaaaaagggggggggggtttttcttattcttcccccggaggtgtgttcccccaaaaaaaaggggggaaaaaaaaaaaaaaaaaactggtgtgtggtggtgtcaccccccaaaccacaaa

SEQ ID NO: 34215 - protein, 66 aa, Zea mays
  misc_feature: Ceres CLONE 1412649-F
  misc_feature (54)..(54): Xaa is any aa, unknown, or other
MATAFDSPTSSPAAAPFHDDPFLHFDGSAPAAADGFPASPGRYAPSPLGMPHSXGDPHDGPFRRTL

SEQ ID NO: 34216 - DNA, 722 bp, Zea mays
  misc_feature: Ceres CLONE 1412651-F
  misc_feature: Translation starting site: 322
  misc_feature (362)..(362): n is a, c, t, g, unknown, or other
  misc_feature (393)..(393): n is a, c, t, g, unknown, or other
aaaagctggagctccccgcggtggcggccgctctagaactagtggatcccccgggctgcaggaattcgcacgagaccattacctagaacatcctaatcgaaaaaaaacgactggctgtccgaacggggacgtctggttcctctcattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcgggggcgatctgatgcgggcgcggcggtgatggcagcgccatccggcggtgggggcgggcggtgcccggngaagggctcctcctcggccgccgcagctgcnacgatcggggtccacggagtggaccaagttgcagaggcgatgtggcagatgaatttggaagaagccatggaactggggccatacccagaagcgtgttggtgagccagactgtagctattacatgaggactggcatggtgcaggtttgcgatgacctgtaaatttaatcacccagcagacaaaaagctgtgtgttgctgctgcaagaatgaagggagtatatcctcaaagaatgtgcagcctgaatgtcatactatctgaagactggacgtgcaagtttgagcaacttgcaagttcatcatccccgagaaagctgcatggcaactcgagt

SEQ ID NO: 34217 - DNA, 714 bp, Zea mays
  misc_feature: Ceres CLONE 1412654-F
  misc_feature (241)..(241): n is a, c, t, g, unknown, or other
  misc_feature (254)..(254): n is a, c, t, g, unknown, or other
  misc_feature (398)..(398): n is a, c, t, g, unknown, or other
  misc_feature (399)..(399): n is a, c, t, g, unknown, or other
caaagctggagctccccgcggtggcggccgctctagaactagtggatcccccgggctgcaggaattcgcacgagaccattacctaagaacatcctaatcgaaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggngccgctcctccancctgcgcgtcgcgccgcctgggatcccgcggcacgtggctaagaagctcagatccggggcgaaaccagccctccgtgggggaggtttcattctacctccagattgcggctgccattccccccctctcttgctgttttttgtggnnggggggggggggggaaaattcggggggggtttttccccccctctcttaaaaaaaaaatttcttttctccttggggaaaaaccgggggtttgtgcccttcccgggtaaagggcggggggggggggcaagtttacccgtaaaaatggaaaaaatttcctgaaaaattccccccgaggagccccccccccccgaacctgaaaattttaaagaggggccccgctttaaagaacagaaaaagtggtggaattttccccgggggcgccccccgcctccccctattttgggggaagtccccccccttttctccccagggggg

SEQ ID NO: 34218 - DNA, 707 bp, Zea mays
  misc_feature: Ceres CLONE 1412655-F
  misc_feature: Encodes the peptide sequence at SEQ ID NO. 34219
  misc_feature (463)..(463): n is a, c, t, g, unknown, or other
  misc_feature (556)..(556): n is a, c, t, g, unknown, or other
  misc_feature (569)..(569): n is a, c, t, g, unknown, or other
caaagctggagctcctcgcggtggcggccgctctagaactagtggatcccccgggctggaggaattcgcacgagaccattacctaaaacatcctaatcgaaaagttgggtgacgtgcgaggtccaagtacccctgtctccctcccgtattgcgggcttgcctttgcctgttccatttccggctcctccagttggtagtgtcgtttcaatgcgagacgccctccttcacgagcttgattgcccttgaaagcgaagttgatgttggtgtcgttgccgatgaggacgaagagtggatatatggctcccacggaagaggcagcaggggaggacgagcgggtgctgaaggatcttctcgcttcttcgtcatataaggaaggagaggatgaatagagtacaaacacacagtccgatgaatctatcagggatggattgtgagtaacgtcggctccgtagccgccttatgnagtgaagatgccaatgataagcatggtagtgacagcaacagtcaatgtgctgaatctgatgtagcgttgcagacaagtgcctgtaaaggtccntagagcagctacnatgagtgcgggtgctgaagtgcctcaaccggatccagagcagtaatgatgatttatgacggctggagctgatgaaatgccagcagcctcctcaaagagcagaaggatgacggcagtgagtgcgctgaccggagctctc

SEQ ID NO: 34219 - protein, 43 aa, Zea mays
  misc_feature: Ceres CLONE 1412655-F
MLVSLPMRTKSGYMAPTEEAAGEDERVLKDLLASSSYKEGEDE

SEQ ID NO: 34220 - DNA, 729 bp, Zea mays
  misc_feature: Ceres CLONE 1412660-F
  misc_feature: Encodes the peptide sequence at SEQ ID NO. 34221
  misc_feature (404)..(404): n is a, c, t, g, unknown, or other
  misc_feature (487)..(487): n is a, c, t, g, unknown, or other
  misc_feature (641)..(641): n is a, c, t, g, unknown, or other
  misc_feature (696)..(696): n is a, c, t, g, unknown, or other
catagctggagctccccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtttncccccccaagagggggggcgcatcgcgtcgctcgccgcgcgcctcgccaagacgccgtcctctcggcccaccttgcttgacanagccgcgcgggggtcgtcgtcgtcgtcccccgatgacgagtccctcgcgtccgtgccgctcggccaggcacgtccggtcggcgtgggcaactacgtcacccgcatgggcctcggcacgccggccaagtcgtaccgtcatggtcgtggacacggngtcctcgctcacctggctcagtgctccccctgccgtcgtgtcgtgccaccgcagncccggccccggtgtcaaaccccaggcgtccagt

SEQ ID NO: 34221 - protein, 35 aa, Zea mays
  misc_feature: Ceres CLONE 1412660-F
  misc_feature (6)..(6): Xaa is any aa, unknown, or other
  misc_feature (24)..(24): Xaa is any aa, unknown, or other
MVVDTXSSLTWLSAPPAVVSCHRXPGPGVKPQASS

SEQ ID NO: 34222 - DNA, 789 bp, Zea mays
  misc_feature: Ceres CLONE 1412663-F
  misc_feature: Encodes the peptide sequence at SEQ ID NO. 34223
  misc_feature (360)..(360): n is a, c, t, g, unknown, or other
  misc_feature (602)..(602): n is a, c, t, g, unknown, or other
  misc_feature (603)..(603): n is a, c, t, g, unknown, or other
  misc_feature (783)..(783): n is a, c, t, g, unknown, or other
  misc_feature (789)..(789): n is a, c, t, g, unknown, or other
aaagctggagctccccgcggtggcggccgctctagaactagtggatcccccgggctgcaggaattcgcacgagaccattacctagaacatcctaatcgaaaaagtaccgcaccaccaccaagcaccgcaaccggagccggagccagaggagggcgagaggccgaggggagaggagcgaaggaggccgccgaccgaccgtgcgtccggccccgcggcggcgtcggcaggtcgtagacggcagacgaggagcagcagcagcacgaggcggccgggcccggcccacgccatgccggagaaggaggcgcaggccgccgcgttctgcggcgaggcggtgatcgccgagttcgagtccctcacgcnggacgccgccgccgtgcagcgcgacacgctgcgccgaattctggaagacaacccctgcgccgagtacctccgctgcgggggccttcggggccggaaccgacgccggcagttttcggggcttggttgccttttcccaagcacggcgaatttgaccctttattgtgcggttttcgcccagggggaaccttccccccggtttttcccggaaaggctttttcccctttttttcccttaattccggnnaagaagggggggaaaagcaattttctttctctttttccagagggtttttggggcccccaggggaaaaatttccggctttttttcctcttttttagagggggtgtttccccggggaagaaaaaaattttttttttttttctttgggggggggtgttttccaccaggggggggttgtttggnaaaacn

SEQ ID NO: 34223 - protein, 102 aa, Zea mays
  misc_feature: Ceres CLONE 1412663-F
  misc_feature (25)..(25): Xaa is any aa, unknown, or other
MPEKEAQAAAFCGEAVIAEFESLTXDAAAVQRDTLRRILEDNPCAEYLRCGGLRGRNRRRQFSGLGCLFPSTANLTLYCAVFAQGEPSPRFFPERLFPLFFP

SEQ ID NO: 34224 - DNA, 744 bp, Zea mays
  misc_feature: Ceres CLONE 1412664-F
  misc_feature (476)..(476): n is a, c, t, g, unknown, or other
  misc_feature (613)..(613): n is a, c, t, g, unknown, or other
  misc_feature (684)..(684): n is a, c, t, g, unknown, or other
caaagctggagctccccgcggtggcggccgctctagaactagtggatcccccgggctgcaggaattcgcacgagaccattacctagaacatcctaatcaaaaagacgtccacagtgcgccgtgttctgccgcgcctgcgctcccaccgcgtgtccgcaactctgccccacctcacatccgcgtccgcaatccgcgcctccgccgccgcagcccttcctccgcgcagcgtccgtccatccatggctctccctacacgcagtgtcgtgccgctttccgcaatccgtgcctcaatccccttccttcgcgcagtgcccttccatccatggctcgcttccagaaatcccctacctacggcgcagcgtcgcagtcaggaatccgcccccaaaatcactacccgctctgcggcgatggaagggaatcaatccgtcaatggaaggaacacgtgcttcccccttccatcctcggcgctgcgcggnattgcggattgcatggccatcgtttcgcgccccaatccgtcgatgaaaggaacgcgtgcttcccccttccatcctcggcgctgcgcgaattgcagattgcatggtcatcgtttcgccccagttcttgcccgcatcanaatggaagggtgccccgatccgcctcactcccatcaatgaggtgcctgccttttcttgcatggagacgccnaagagaaggaaccaatcactaagtcggcctctgtacgtccatgaacacacatcacgggag

SEQ ID NO: 34225 - DNA, 768 bp, Zea mays
  misc_feature: Ceres CLONE 1412666-F
  misc_feature: Translation starting site: 128
  misc_feature (146)..(146): n is a, c, t, g, unknown, or other
  misc_feature (304)..(304): n is a, c, t, g, unknown, or other
  misc_feature (455)..(455): n is a, c, t, g, unknown, or other
  misc_feature (493)..(493): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (560)..(560): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
aaaagttggagctccccgcggtggcggccgctctagaactagtggatcccccgggctgcaggaattcgcacgagaccattacctaaaacatcctaatcgaaaactttcagcggagcgcggcggcaagatggcagtgcaaatatccnagaagaggaagtttgtcgctgatggcatcttcaaagctgaactgaatgagtttcttactcgggagctggctgaagaatggctactctggagttgaggtgcgagttacaccaaccaggacagaaatcattatcttagccatcagaacacagaatgttcnttggtgagaagggccggcggattcgggaactgactgctgtagttcagaaagaggtttggctttccagagggcagtgtagagctttatgctgaaaaggggccactaagaggtctgtgtgccattgcccaggcagagtctctgcgttacaacntcctaggagggcttggttgtgcggaggccttgctatgnttgtgctgcggtcatcaatgggagagtgggcaaaggctggaggttnnnngnggtccttttnnnaaanttcnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttnnnnnnnnnnnnnnnnnnnnnnntnnnnnnnnnnnnnnnnt

SEQ ID NO: 34226 - DNA, 675 bp, Zea mays
  misc_feature: Ceres CLONE 1412668-F
  misc_feature: Translation starting site: 433
  misc_feature (290)..(290): n is a, c, t, g, unknown, or other
  misc_feature (292)..(292): n is a, c, t, g, unknown, or other
  misc_feature (293)..(293): n is a, c, t, g, unknown, or other
  misc_feature (299)..(299): n is a, c, t, g, unknown, or other
  misc_feature (301)..(301): n is a, c, t, g, unknown, or other
  misc_feature (326)..(326): n is a, c, t, g, unknown, or other
  misc_feature (453)..(453): n is a, c, t, g, unknown, or other
  misc_feature (661)..(661): n is a, c, t, g, unknown, or other
  misc_feature (663)..(663): n is a, c, t, g, unknown, or other
tggagctccccgcggtggcggccgctctagaactagtggatcccccgggctgcaggaattcgcacgagaccattacctagaacatcctaatcgaaaactcttcttttccccctcctcccgctggcctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggtttgacgcgaggaggggcngnncgcgcncnagggacatatgggtgagatccgcangagccgccgcgaggagagccttctcaagaggcgccgcgaggggctccaggcccaggtcccctgcccctccctcgggggtcgagaagaagcttgaaagctcccagctatggtcagtgggggttattcngatgacaataaccttcagcttgagggcaccacacagtttcgcaaggtgctatctatagagaggagccctcccattggagaagtatcaaatcaggtggtagtcccagatttgtgcagttgctcacaagagaggatttgcccccagctgcagtcgaagcagcatgggctctcacgagtatggcttctggcacttcagaaaatacaaaggntngtattgatcatg

SEQ ID NO: 34227 - DNA, 864 bp, Zea mays
  misc_feature: Ceres CLONE 1412673-F
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ngtgccctcccnnncntggggtgcgggggggggggttnnnnnaacnnnnttcaagctggagctccccgcggtggcggccgctctagaactagtggatcccccgggctgcaggaattcgcacgagaccattacctagaacatcctaatcggaaaacatcgacccagccatctcctcaccctcgttcaccacacagtccgccactcctttagtagcttgtgatttgtacgtcgacgagatcactggtcggggtggcggacgacgacacatggggaaagggtagggggggtgcatcatgggggggcgttcctcctggtcgccggcgtggtggttggccaaacacccacggccggggcggagggacggagtgggcccaacgggaccgccagggggggccctgcggggggggcaaacaagggggtgcgaaggggaaaaaacgaaaaagggacccccccccgaaaaagggaaatgggaaaaagggagttgcccccgaagcggccacccagcaaattttgacccggggcggaaggaacggccaaaacggggggggggggaacccctataatttttcccgctttcggggaagaggggggagaaagggtgcccggggcccccaggtgccctccgccccccccccgcaaggggggcccagcccggggggaaacaccccccgggggtggcgcggggggggggggggcccccccccccccggcggactggggccccgcccacaatgtgggagaagaaaaattaaccgccccggcggcagaaaaaaagggcggtgaaaatgttcgccgagaagaggggggtgaccccccccccccgcggggaggaatgggggggggggaaagacgctcttctcgtgg

SEQ ID NO: 34228 - DNA, 666 bp, Zea mays
  misc_feature: Ceres CLONE 1412676-F
  misc_feature: Encodes the peptide sequence at SEQ ID NO. 34229
tggagctccccgcggtggcggccgctctagaactagtggatcccccgggctgcaggaattcgcacgagaccattacctagaacatcctaatcgaaaagccacattttacatcccaccaccagcctccttcccctttccgttccccgaagcgagagcgaagccagcgcccatcttcttcttcctcctccttgttgttggatcgcagctccttcgtcgtagcgtccgatacgccaggtttcctttcgcgagcaacaatctttggcaatggcgtccacgtcgagctcgacgccagcgccggttgaggtggacgagaggggccggaagcggaagcgtgcggccggggcggaccccgcggcgccggcgcagccgtccaagtggcggacgcggcgcgagcacgagatctactcgtccaagctcctggaggcgatccgcctcgtgcgcgcggggaccccctccgccgccgccgccggcacggcggcggccccgccgcgcatcagggccgtgcgcgaggaggacgaccgtgcgctcggcgtcacggagcgcgggcgcaggacactctatatatgccatcatcgcatcccgccggagccgcctccaggccttggcatcgcgcgcgcctccgcggcctagcgatgtcactgaggagatacagaggcccctcgagag

SEQ ID NO: 34229 - protein, 121 aa, Zea mays
  misc_feature: Ceres CLONE 1412676-F
MASTSSSTPAPVEVDERGRKRKRAAGADPAAPAQPSKWRTRREHEIYSSKLLEAIRLVRAGTPSAAAAGTAAAPPRIRAVREEDDRALGVTERGRRTLYICHHRIPPEPPPGLGIARASAA

SEQ ID NO: 34230 - DNA, 685 bp, Zea mays
  misc_feature: Ceres CLONE 1412683-R
  misc_feature: SWISSPROT Homolog: EC 3.2.1.14 Chitinase
  misc_feature (531)..(531): n is a, c, t, g, unknown, or other
  misc_feature (609)..(609): n is a, c, t, g, unknown, or other
ccgattgggtaccgggccccccctcgaggtcgacggtatcgataagcttttttttttttttttttgcggtgaaacagtgatcgcctacacaccgtttattgattcagcctttaaacccttgctgcatacaatgcaatcgtaaagtacaagcgctctgcaagcgtacacgttgtgtcgaaacaacatgcatatcacagctgcttcattattcaggtcgaagtcgaacaaacaggctcagctagccccggcgttttattgtcactattgctcggtttcgcgcgcgagggtgcgatgcgacgccgagcacaaggcctgaaggcccccgccgtccgccgatgccgcctagcctagcaggtgaggttgggcccggggtcgacgccgagctggcggcagtactgcctgtagtagccgacgcgcgcgttcatctgggcggggttgttcccgccgcactcgagggcgccgttgatggcccctggtgggtggcgcccgaaccccctgcggcaccacccccgtgcacgcttgttcatcccnaaaacagaaacggccgcccttgaaacgcaaccacgggggtccccgggccaccctggccgggttccccgagccccgtcnaaacccaaagggccctcccccgcggggcccgtaatttgtatttccccaaaaattttcaacggggcccggccccctt

SEQ ID NO: 34231 - DNA, 669 bp, Zea mays
  misc_feature: Ceres CLONE 1412688-F
  misc_feature: Encodes the peptide sequence at SEQ ID NO. 34232
  misc_feature (263)..(263): n is a, c, t, g, unknown, or other
aaagctggagctccccgcggtggcggccgctctagaactagtggatcccccgggctgcaggaattcgcacgagaccattacctagaacatcctaatcgaaaaaattccccatcgcgataggcccgttcgcacgaaagactgctctgctttcaccccccgcatcgaacctcacccccgatctgatcgaatcgaaggctgcggcggcgatgggcggtgaccatggcggtgggcacgccggcggcgacttccgccagaaggtgggnagcatgacgggcggcccgtactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctccaactagcatgaagtgcgggcaccttgcttttggccttctttttgggggaaacctggggcctacccctaatgctggggttaaggggtaaggagcatctccgggaagggttcgcggaaaaaccttttgaatcctcctttccctccggggaaaatggggaaaagggcctgatgaacttcaaaatatgggccggggggaaccaaaggg

SEQ ID NO: 34232 - protein, 82 aa, Zea mays
  misc_feature: Ceres CLONE 1412688-F
MGGDHGGGHAGGDFRQKVGSMTGGPYCRPVHWRRNTAIAMFGVFLICIPIAMKSAELEQRPHHPVRPIPSQLWCKNFGKKEY

SEQ ID NO: 34233 - DNA, 687 bp, Zea mays
  misc_feature: Ceres CLONE 1412691-F
  misc_feature: Encodes the peptide sequence at SEQ ID NO. 34234
  misc_feature (494)..(494): n is a, c, t, g, unknown, or other
  misc_feature (496)..(496): n is a, c, t, g, unknown, or other
  misc_feature (497)..(497): n is a, c, t, g, unknown, or other
  misc_feature (499)..(499): n is a, c, t, g, unknown, or other
  misc_feature (500)..(500): n is a, c, t, g, unknown, or other
  misc_feature (502)..(502): n is a, c, t, g, unknown, or other
  misc_feature (568)..(568): n is a, c, t, g, unknown, or other
  misc_feature (569)..(569): n is a, c, t, g, unknown, or other
  misc_feature (576)..(576): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (588)..(588): n is a, c, t, g, unknown, or other
  misc_feature (612)..(612): n is a, c, t, g, unknown, or other
aaagctggagctccccgcggtggcggccgctctagaactagtggatcccccgggctggaggaattcgcacgagaccattacctagaacatcctaatcgaaaaatatctcctcaagggacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatccccgccgcagctcctcgccgcgtggggagagtacctctcctccacccgcgccaggggcggcgacgtccccacggagggggaccaccagttcatgatggaccaattcaagggtgcgccgtgccccccgcccccgaaccaccactggaccggcgtgccctaccgcacccgggggagggccggcgcngnngnngnacccccccccgggggcctacgcggggggaggccgggccggacttccgggggcgcccgggcgggggnnctccgtncccnnnnnggtnccccttgcccgctcggccctaggnccttttttattcgggggccacccgttccccttttcggacggggacctatcggttggcctcataaactcccttctc

SEQ ID NO: 34234 - protein, 127 aa, Zea mays
  misc_feature: Ceres CLONE 1412691-F
  misc_feature (90)..(90): Xaa is any aa, unknown, or other
  misc_feature (91)..(91): Xaa is any aa, unknown, or other
  misc_feature (92)..(92): Xaa is any aa, unknown, or other
  misc_feature (115)..(115): Xaa is any aa, unknown, or other
  misc_feature (117)..(117): Xaa is any aa, unknown, or other
  misc_feature (119)..(119): Xaa is any aa, unknown, or other
  misc_feature (120)..(120): Xaa is any aa, unknown, or other
  misc_feature (121)..(121): Xaa is any aa, unknown, or other
MVSRENLHLVLDPASLGAPWADPSAAEIPAAAPRRVGRVPLLHPRQGRRRPHGGGPPVHDGPIQGCAVPPAPEPPLDRRALPHPGEGRRXXXTPPRGPTRGEAGPDFRGRPGGGXPXPXXXPLPARP

SEQ ID NO: 34235 - DNA, 742 bp, Zea mays
  misc_feature: Ceres CLONE 1412694-F
  misc_feature: Encodes the peptide sequence at SEQ ID NO. 34236
  misc_feature (8)..(8): n is a, c, t, g, unknown, or other
  misc_feature (11)..(11): n is a, c, t, g, unknown, or other
  misc_feature (12)..(12): n is a, c, t, g, unknown, or other
  misc_feature (22)..(22): n is a, c, t, g, unknown, or other
  misc_feature (47)..(47): n is a, c, t, g, unknown, or other
gggggggnccnncccccccccnccccccaagtgggggggccgcacancaacacaactggggctccccgcggtggcggccgctctagaactagtggatcccccgggctgcaggaattcgcacgagaccattacctagaacatcctaatcgaaaatccacgccccgcacgcacacgacccgcagaccgcaccctggcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtggttatggccctcatcggcgggctccgctactttgtctccaagctcatgcgctccccggcgacctctccgtctcccgaccccaaggtcgttaaggaagggcaggtggtcatcaggggcgaggaacctgaggaccaacgcacagttcatcccggggcaaggctttcaaggcacgcaaggtttattacaccaacgaggaagatggattacttcatggtccaaaggaagacgcgcagaagggtcagggaggcatggttttctgatcggaacatggccctggacatgatgaaaaagaacctatccctgatagttcctcagacacttacatttggatggggggaactttttcctttccaggtttccgtggcagcaaaaatcccgctttccatggactcagaagat

SEQ ID NO: 34236 - protein, 154 aa, Zea mays
  misc_feature: Ceres CLONE 1412694-F
  misc_feature (2)..(154): Pfam Name: DUF850 Pfam Description: Eukaryotic protein of unknown function (DUF850)
MAEDLVLDTAIRDWVLIPLSVVMALIGGLRYFVSKLMRSPATSPSPDPKVVKEGQVVIRGEEPEDQRTVHPGARLSRHARFITPTRKMDYFMVQRKTRRRVREAWFSDRNMALDMMKKNLSLIVPQTLTFGWGELFPFQVSVAAKIPLSMDSED

SEQ ID NO: 34237 - DNA, 681 bp, Zea mays
  misc_feature: Ceres CLONE 1412695-F
  misc_feature: Translation starting site: 197
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (656)..(656): n is a, c, t, g, unknown, or other
  misc_feature (662)..(662): n is a, c, t, g, unknown, or other
tggagctccccgcggtggcggccgctctagaactagtggatcccccgggctgcaggaattcgcacgagaccattacctagaacatcctaatcgaaaaaaagataagaaaggcggtggtcaacttgtgtcctgaggtgcccgtagaagcccaaggacaagaaacaaggagaagagtagatctacatctactccaccgatgagcgtgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttggtctgtgggatacagcaggacaagaagattacaatagactgcgtccgttgagctatcgtggtgctgatgtttttctgctcgccttttctcttatcagcaaagcaagctatgagaatgtctctaaagaagtgggttcctgaattaaggactatggctcctggcgtgcccataatccttgttggacaaaacttgatctgcggaatganannccagttttttgtggatcccccctggtgctggtccatttccactgccagggcgaagagctgagaaagctaattgggtgctgcgnctacantcgatggcagtcaaaaacc

SEQ ID NO: 34238 - DNA, 594 bp, Zea mays
  misc_feature: Ceres CLONE 1412696-F
  misc_feature: Encodes the peptide sequence at SEQ ID NO. 34239
  misc_feature (301)..(301): n is a, c, t, g, unknown, or other
  misc_feature (351)..(351): n is a, c, t, g, unknown, or other
  misc_feature (364)..(364): n is a, c, t, g, unknown, or other
  misc_feature (416)..(416): n is a, c, t, g, unknown, or other
  misc_feature (430)..(430): n is a, c, t, g, unknown, or other
  misc_feature (431)..(431): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaaaccagagagtcagagtgcggaggtgaacgtgacgtgacgctcctcctctataaaaggagacgcctgtgctgcagtgtgcacagcacagcccgtcgcgcgccgctgcgttgaggttgagccaaggcgcaatggcacctccacctcagttcccgtcctcctgctcctcgccgccgccgccggcctcctcctgctccccggntcgctggcgtggcagagcagacactgtgcaccgggcgcgcccgcagtggnctcgcgacgtggnctcacccgctcggctccggcggcggcacagcccgcccacatagcagccgccnagcacaccatggcnnagcgccagtgcccgcgtgcaccctccgtacgtgcctcgacgctcgcccgtaccggcgtaagtgccacatatggcccggcgaagccttgggcataacaaccaccggagggcccacattaggtcccgtcccggcaaagcctcgggccctaaccgcccagggggcn

SEQ ID NO: 34239 - protein, 33 aa, Zea mays
  misc_feature: Ceres CLONE 1412696-F
  misc_feature (3)..(3): Xaa is any aa, unknown, or other
MAXRQCPRAPSVRASTLARTGVSATYGPAKPWA

SEQ ID NO: 34240 - DNA, 586 bp, Zea mays
  misc_feature: Ceres CLONE 1412697-F
  misc_feature (51)..(51): n is a, c, t, g, unknown, or other
  misc_feature (61)..(61): n is a, c, t, g, unknown, or other
  misc_feature (62)..(62): n is a, c, t, g, unknown, or other
  misc_feature (74)..(74): n is a, c, t, g, unknown, or other
  misc_feature (237)..(237): n is a, c, t, g, unknown, or other
  misc_feature (238)..(238): n is a, c, t, g, unknown, or other
  misc_feature (529)..(529): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
aagctggagctccccgcggtggcggccgctctagaactagtggatcccccngggctgcagnngaattcgcacgnagaacccattacctagaacatcctaatcgaaatgcggtctgcctctgcccttaccgctacgctttcctcccggattcagcagcgaaacacgcgcggggcaaggacgggagctgtaagccgatcgagcccgcgagggtggacagatgatgatggccgaagtggnncgcaccacagcaaaagaggcacacgacggttacttcatggcaaaagcgcccccgccgcccccgaagcccaaggattgggaaaattgccttggcctcaaaaaaccaagaaaaaaaaagcccaaaaccggccccgattccccaagggaaaaaagcaggatccccaaaaaaaaccccgggccccccaaaaaaatggggccccccttgggaaaaaaaaaaaaaagttttttctttttttgggaaagggggggggccggggagaaaaaaaaaaggtttgcctccgcgcccccaaanaannnncgcggggggggggggcccccccccccccaaaagggggggggggcccgcggg

SEQ ID NO: 34241 - DNA, 593 bp, Zea mays
  misc_feature: Ceres CLONE 1412701-F
  misc_feature: Encodes the peptide sequence at SEQ ID NO. 34242
  misc_feature (377)..(377): n is a, c, t, g, unknown, or other
  misc_feature (530)..(530): n is a, c, t, g, unknown, or other
  misc_feature (532)..(532): n is a, c, t, g, unknown, or other
  misc_feature (533)..(533): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
aaagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcagggcatggaggtgcgcgtcaagatcctcttcacctcgctctgccacaccgacgtctacttctggggaggncaggggcagactcccgtgttccctcggatctttggccccgaggcttggaaggattccctaaaaaaggtttgaaaaaaggggtgggacttttataaaaaaaatttcccccgcggggagagagaaaaaaaaaatatcccccctctcctctctctntnnggggnnnnntgaggggggggaggaggaggggggggcccccccccctccccaaaaaaaaaa

SEQ ID NO: 34242 - protein, 79 aa, Zea mays
  misc_feature: Ceres CLONE 1412701-F
  misc_feature: SWISSPROT Homolog: EC 1.1.1.1 Alcohol dehydrogenase
MATAGKVIKCKAAVAWEAGKPLSIEEVEVAPPQGMEVRVKILFTSLCHTDVYFWGGQGQTPVFPRIFGPEAWKDSLKKV

SEQ ID NO: 34243 - DNA, 700 bp, Zea mays
  misc_feature: Ceres CLONE 1412702-F
  misc_feature: Encodes the peptide sequence at SEQ ID NO. 34244
  misc_feature (236)..(236): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (419)..(419): n is a, c, t, g, unknown, or other
  misc_feature (423)..(423): n is a, c, t, g, unknown, or other
  misc_feature (462)..(462): n is a, c, t, g, unknown, or other
  misc_feature (463)..(463): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (533)..(533): n is a, c, t, g, unknown, or other
  misc_feature (562)..(562): n is a, c, t, g, unknown, or other
  misc_feature (563)..(563): n is a, c, t, g, unknown, or other
  misc_feature (567)..(567): n is a, c, t, g, unknown, or other
  misc_feature (583)..(583): n is a, c, t, g, unknown, or other
  misc_feature (585)..(585): n is a, c, t, g, unknown, or other
  misc_feature (700)..(700): n is a, c, t, g, unknown, or other
aaagctggagctccccgcggtggcggccgctctagaactagtggatcccccgggctgcaggaattcgcacgagaccattacctagaacatcctaatcgaaaaatccgactaaaaagggccagggccagggccttcgcttggttactactcctggttaccacactctaccttgtctcttcacgtgcacacgacgcctcccccaatggctgcggtggcggaggaggaggtgatcgtcntcggcgcggggcagtcggggctagcggtggcggcgtgcctgtccctgcgcggcgtgcgggcgctggtcctggagcgcgacgactgcgtgggggtcgcttgtggcggaggcgcgcctacaaccggctccannnctccactcaccaagaagtactggcgcgctggcgcacgcgccgcaccccggncganggcccccgcgtactggcaccgcgacgaccttcggcgggnnacctgggacgggaaaccccccgggggggtttggccggtcggcccgcgctnnnnggcgggaggggtcgggntcgggggcggtacgacccccgcgagcgcnncggnggggaaggtggaaggncntgggacctcggcacggggcaagggcgagcgggaccgcggggagggttcctgggggggtcggggcccggggagaaccgccgggatgtccctggcgggaggtgcttggggctggagn

SEQ ID NO: 34244 - protein, 165 aa, Zea mays
  misc_feature: Ceres CLONE 1412702-F
  misc_feature (12)..(12): Xaa is any aa, unknown, or other
  misc_feature (55)..(55): Xaa is any aa, unknown, or other
  misc_feature (56)..(56): Xaa is any aa, unknown, or other
  misc_feature (73)..(73): Xaa is any aa, unknown, or other
  misc_feature (74)..(74): Xaa is any aa, unknown, or other
  misc_feature (87)..(87): Xaa is any aa, unknown, or other
  misc_feature (104)..(104): Xaa is any aa, unknown, or other
  misc_feature (105)..(105): Xaa is any aa, unknown, or other
  misc_feature (111)..(111): Xaa is any aa, unknown, or other
  misc_feature (121)..(121): Xaa is any aa, unknown, or other
  misc_feature (122)..(122): Xaa is any aa, unknown, or other
  misc_feature (128)..(128): Xaa is any aa, unknown, or other
MAAVAEEEVIVXGAGQSGLAVAACLSLRGVRALVLERDDCVGVACGGGAPTTGSXXPLTKKYWRAGARAAPRXXAPAYWHRDDLRRXTWDGKPPGGVWPVGPRXXAGGVGXGGGTTPASAXXGKVEGXGTSARGKGERDRGEGSWGGRGPGRTAGMSLAGGAWGW

SEQ ID NO: 34245 - DNA, 757 bp, Zea mays
  misc_feature: Ceres CLONE 1412708-F
  misc_feature: Encodes the peptide sequence at SEQ ID NO. 34246
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
tattttgatccccccccccnnntacggggaaagagagaaaaggnccccctcnnnnnncaaagctggagctccaccgcggtggcggccgctctagaatagtggatcccccgggctgcaggaattcgcacgagaccattacctagaacatcctaatcgaaaaagaaagagtccgtaaacaactcccggccatggcgaccgcagaccgggtcgccgccaccttcctctcctctttccccactcaccatccccgccccttttcctccgtttccctcgtgacaaaccctgtccctacccgtctcccttcgggcccgctggtcacaggtgggccccacgggttcgcctccccggctcccggtccaccgcgttcggcgccccccgtcccccagtttccccaccacgaaaccgggaggtagctttcgggggaaaaaaaaaaaaatcaaaagggccattaaggggggctgtggggggtcctttttttgccatggcaaaaaccttggaaggccccccgaaaaaaatgggggaaaccctcaccccacgggggcccccgaggggggcccccccccgggggggcattttttggggggaaagggaaattatgtgggggacaaacaaaaacttttttgggggggggtaaagggaaaaccacccttttcctcaagagggggggggggggggggcaaccaaattggtcttttcgaaaaaaaacaaaaaaggggttttatttttaccccgccgggctcccaccactgggggggaa

SEQ ID NO: 34246 - protein, 74 aa, Zea mays
  misc_feature: Ceres CLONE 1412708-F
MATADRVAATFLSSFPTHHPRPFSSVSLVTNPVPTRLPSGPLVTGGPHGFASPAPGPPRSAPPVPQFPHHETGR

SEQ ID NO: 34247 - DNA, 674 bp, Zea mays
  misc_feature: Ceres CLONE 1412711-F
  misc_feature: Encodes the peptide sequence at SEQ ID NO. 34248
  misc_feature (160)..(160): n is a, c, t, g, unknown, or other
  misc_feature (165)..(165): n is a, c, t, g, unknown, or other
  misc_feature (325)..(325): n is a, c, t, g, unknown, or other
  misc_feature (365)..(365): n is a, c, t, g, unknown, or other
  misc_feature (367)..(367): n is a, c, t, g, unknown, or other
  misc_feature (368)..(368): n is a, c, t, g, unknown, or other
tggagctccccgcggtggcggccgctctagaactagtgggtcccccgggctgcaggaattcgcacgagaccattacctagaacatcctaatcgaaaaagtactttcgctagctcccttccggtcccttcccacgaaaacccggagaaagggagtgagaanaaagncaacaagaaagcgggagagccaacgcgcaacgcagcgccctgagatggcggcgccggcgccggcgccgaagcaggaggagctgcagccgcacgccgtcagggaccagctgccctccgtctcctacgtgctggacagcccgcccccatgggcgggagggcngtcctcctcgggttccaggactaccctcgtcatgctcggnanncacgtcatcatccccaccgggctcggtgcccagatgggccggcgcatgaggaaagggcccggttgtcaaaacccttcttgttcctggcccggatcaaacgggtggcccaaaggttccccggaagggcgctcccggcggatgggggggctccaaaacgttgggggggccacaattcctttttcctctcggggggggaagggggttccccccccccccaaaaaattcccggcttatggggggggaaaaagggggcttttttgggccccccccccccaaaaaagggggtgtcgggggggttttggagag

SEQ ID NO: 34248 - protein, 155 aa, Zea mays
  misc_feature: Ceres CLONE 1412711-F
  misc_feature (39)..(39): Xaa is any aa, unknown, or other
  misc_feature (53)..(53): Xaa is any aa, unknown, or other
MAAPAPAPKQEELQPHAVRDQLPSVSYVLDSPPPWAGGXSSSGSRTTLVMLGXHVIIPTGLGAQMGRRMRKGPGCQNPSCSWPGSNGWPKGSPEGRSRRMGGLQNVGGATIPFSSRGGKGVPPPPKKFPAYGGGKRGLFWAPPPQKRGCRGGFGE

SEQ ID NO: 34249 - DNA, 747 bp, Zea mays
  misc_feature: Ceres CLONE 1412714-F
  misc_feature: Translation starting site: 151
  misc_feature: SWISSPROT Homolog: EC 3.4.16.6 Carboxypeptidase D
  misc_feature: SWISSPROT Homolog: EC 2.3.1.92 Sinapoylglucose--malate O-sinapoyltransferase
  misc_feature (400)..(400): n is a, c, t, g, unknown, or other
  misc_feature (538)..(538): n is a, c, t, g, unknown, or other
  misc_feature (541)..(541): n is a, c, t, g, unknown, or other
  misc_feature (631)..(631): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacctagaacatcctaatcaaaaaaccaaccaaccagtgctgtcctccgccgatccactgacctaccgcgagcgccaatggcgaccgccgcggtcctcgccgccacattagcgctgttcctcggcgccgccgccgcaacggccgcgacggctgcggcggaggcggaccggatcggcaggctgccgggccagccgccggtcaacttctccatgtactccggctacgtcaccgtggacgcggcggcggggcgggccctcttctactggttcatcgaggcggccggcgtgcccgcggagtccgcgccgctcgtgctgtggctcaacggcngggcccgggtgctcctccgtcggctacggcgcgtcagaggagctcggcgccttccggatcaacgccgacggcaggacgctctacttgaacccctacccctggaataaagtggcgaacatgctgttcttggactcgccnggncggcgtcggctactcatactccaactccacctccgatctgtacactgccggtgacaacaagacagcccatgactcgtacaatttcttggntgaactgggctggagcggnttccacaaatacagcatcgcgatttctacatcacaggagaagagctacgcaggccatttacggggcctcagttgtctcagctagtctaccggaacaa

SEQ ID NO: 34250 - DNA, 757 bp, Zea mays
  misc_feature: Ceres CLONE 1412715-F
  misc_feature: Encodes the peptide sequence at SEQ ID NO. 34251
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgcctccggccccggccacacccaagccgccgccagcggtggaggagaagggcggtgtcgccgcggtggagctcacgggcgtcccgcgtagggttaacgtgaaggcgcgccgcctgcggacaaaaacgggcacggaggtggtcgcgatgcacgggcgccaggcggggcccatgctcacgctgctctaattccaagggaaacggcgccagacctcgggcaagaggaacaagctctttcgcggagctccggggcccacctcaacggcaaccctcagtggggaatggactaattcggggtttatgggaaatctaactgggaatgcccaaagggacacaaaacactttattcctgaaaataa

SEQ ID NO: 34251 - protein, 118 aa, Zea mays
  misc_feature: Ceres CLONE 1412715-F
MGAVTSTVAARFAFFPPSPPSYGFEQPAPLPAPATPEPPAPATSKPPPPAPATPKPPPPAPATPKPPPAVEEKGGVAAVELTGVPRRVNVKARRLRTKTGTEVVAMHGRQAGPMLTLL

SEQ ID NO: 34252 - DNA, 706 bp, Zea mays
  misc_feature: Ceres CLONE 1412716-F
  misc_feature: Encodes the peptide sequence at SEQ ID NO. 34253
  misc_feature (374)..(374): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcaaaaaatctccatcggccatcgctgcctccccagtccccacatccgcacacatttttacccctcgcggcggccccaccgaccgccggggcgcagcggcgtcgccgcgggcaacgccgtcacgtcacgtgcatcacgacaatctcctcctccgcctcgtcttcctgccaggccgcgggagcaccagcccagcggcagatcagtcgaggcgggcgattccagggtttagagaggagcggagatggtgaaggtcatccaggggcgcccggccgagatgtngttccggatgcccgcgnagtgggaagcgcacgagcagtgctggatgggatggcctgagcgtccaaatactgggaggagaatgctggtccagctcaagaggatttgctagaactggcaatgcatttcaaagttggaacccgcacgttaggggcagggccaacattaccccaaatccccgaggtgatggacatgaaaccacatcatgtcccttagaataaaatgaacaaattctgggtcccgaaaggggccccacttttggccctctaaagggggatccgggatttgcaaaaaacaaagccgggattgtgtgggattccgcggccggggagaaa

SEQ ID NO: 34253 - protein, 48 aa, Zea mays
  misc_feature: Ceres CLONE 1412716-F
  misc_feature: SWISSPROT Homolog: EC 3.5.3.12 Agmatine deiminase
  misc_feature (13)..(13): Xaa is any aa, unknown, or other
  misc_feature (19)..(19): Xaa is any aa, unknown, or other
MVKVIQGRPAEMXFRMPAXWEAHEQCWMGWPERPNTGRRMLVQLKRIC

SEQ ID NO: 34254 - DNA, 730 bp, Zea mays
  misc_feature: Ceres CLONE 1412717-F
  misc_feature: Encodes the peptide sequence at SEQ ID NO. 34255
  misc_feature (649)..(649): n is a, c, t, g, unknown, or other
  misc_feature (650)..(650): n is a, c, t, g, unknown, or other
ccaagctggagctccccgcggtggcggccgctctagaactagtggatcccccgggctgcaggaattcgcacgagaccattacctagaacatcctaatcgaaaaccttcgcattaatggacgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtcccccttccatactccctagcatgctcggctcgcaccccggattgatcgagctcgcccgtcgccgcgatggattcggtgccttccccctcctcttctacccgggccaccgctgctcccggtccctgctgccgctttgacgcgctgcggagggcgtgcgccaggcacgccgccgccgccgcgcgggccggcgggtgggcgctcggagcgctgctcaactgcgtcttcgccgtagtggactcagtcggcggaatcttcattggtgctttcatggggatgtctacagaaagcggcatgctccgcggcgctgcgtgtcgaagcagtctcgggagcagtcttctccattggaggctgttgagtctgcatcgaannatttggaagtccagccattcggtgaaatacagtcatcgtctatgtgctggacatcatctctagactctgcagcggaagaa

SEQ ID NO: 34255 - protein, 121 aa, Zea mays
  misc_feature: Ceres CLONE 1412717-F
  misc_feature (101)..(101): Xaa is any aa, unknown, or other
MDSVPSPSSSTRATAAPGPCCRFDALRRACARHAAAAARAGGWALGALLNCVFAVVDSVGGIFIGAFMGMSTESGMLRGAACRSSLGSSLLHWRLLSLHRXIWKSSHSVKYSHRLCAGHHL

SEQ ID NO: 34256 - DNA, 772 bp, Zea mays
  misc_feature: Ceres CLONE 1412723-F
  misc_feature: Translation starting site: 160
  misc_feature: SWISSPROT Homolog: EC 1.2.1.3 Aldehyde dehydrogenase (NAD(+))
  misc_feature (338)..(338): n is a, c, t, g, unknown, or other
  misc_feature (365)..(365): n is a, c, t, g, unknown, or other
  misc_feature (371)..(371): n is a, c, t, g, unknown, or other
  misc_feature (399)..(399): n is a, c, t, g, unknown, or other
aaagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtgggaggcgtccgtgcacgactacnaggagggcatgcgcgcctgcttcgatngcgcangacatggatggcgattcctgctccaagncgaagagagatcgttagggcaaatcggtgatgcactgaaagcaaagctcatccaccttgggcaggttggggcactggaagatggggaaatcctcctggagggaatccggggagggttcaggagatcctcgacgggggggttttatgctggggggggtaaagcccccactaaaggggtccctttaacccttggaaggccaaccctttgtggggggggggggggggagcccccttgggggggggtgggggggtaaaacggatttaattccccgggggggggtttggggagaaagtgtcaattttttttcccgggaaaaatttggcccccgaagagagggccccaccccccccgttttttttttgcgaggaaatgt

SEQ ID NO: 34257 - DNA, 776 bp, Zea mays
  misc_feature: Ceres CLONE 1412724-F
  misc_feature: Encodes the peptide sequence at SEQ ID NO. 34258
  misc_feature (488)..(488): n is a, c, t, g, unknown, or other
  misc_feature (499)..(499): n is a, c, t, g, unknown, or other
  misc_feature (678)..(678): n is a, c, t, g, unknown, or other
  misc_feature (704)..(704): n is a, c, t, g, unknown, or other
  misc_feature (744)..(744): n is a, c, t, g, unknown, or other
  misc_feature (750)..(750): n is a, c, t, g, unknown, or other
acaagctggagctccccgcggtggcggccgctctagaactagtggatcccccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccactttgtctccggccaaggcggcagctggagcagaggcggtgcgatcgatccgcgcgcggcagatcgtggacagccgcgggaaccccaccgtcgaggtcgacctcgtcgccggggacggacgcctccaccgctccgcggtgcccagcggggcgtccacggggatctacgaggcgctggagctccgcgacggtgacnaggccgtatancggcgggaagggcgtactccaagctgtgcgcaacatcaacgaggttatcgcgcctaagctcatagggcgtcgatgtgaggacccaaagcgatgttgatgcagtcatgcttagacattgatggactcaaaataaatcccggaagttgggtgccatgctaattctcgaggtctccttgaantgtattgtaggggcagcgctggtgtncaaggggaagttcttctgtattaacatattcggagctagnagggantttaatcggggtttggtcatgcctgt

SEQ ID NO: 34258 - protein, 121 aa, Zea mays
  misc_feature: Ceres CLONE 1412724-F
  misc_feature: SWISSPROT Homolog: EC 4.2.1.11 Phosphopyruvate hydratase
  misc_feature (100)..(100): Xaa is any aa, unknown, or other
  misc_feature (103)..(103): Xaa is any aa, unknown, or other
MAHPHLVLPSPKSLLPAAATPSRRAVAIRAALSTTLSPAKAAAGAEAVRSIRARQIVDSRGNPTVEVDLVAGDGRLHRSAVPSGASTGIYEALELRDGDXAVXRREGRTPSCAQHQRGYRA

SEQ ID NO: 34259 - DNA, 741 bp, Zea mays
  misc_feature: Ceres CLONE 1412728-F
  misc_feature (344)..(344): n is a, c, t, g, unknown, or other
  misc_feature (377)..(377): n is a, c, t, g, unknown, or other
  misc_feature (385)..(385): n is a, c, t, g, unknown, or other
  misc_feature (645)..(645): n is a, c, t, g, unknown, or other
  misc_feature (646)..(646): n is a, c, t, g, unknown, or other
  misc_feature (691)..(691): n is a, c, t, g, unknown, or other
  misc_feature (694)..(694): n is a, c, t, g, unknown, or other
atagctggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggagccggnagcggatcggcggcggatgcatgctggaggtcnccgccgancctgcacaaaaaccagcaagagaccgccagacaatcggcgtggacctgagaaaaaagctccatcaccttgggaaggtttgtgtcacttgaatgggaaaaattcttcctggagggaatcggtgaggctgaagaaaaccttcgacaggtgggcatatggtgtggggggtagcccgcccaccaaatggatcccttataccctctggaaccccccaacccatatgaggggggagggcgcgggaatcccctctggaattgggcgnngtaaaaaaccaacacttaacttccccctggagcaggcccttgctncgnattgcttgctatgggctttggaccggtaagcaatttggcggctcacc

SEQ ID NO: 34260 - DNA, 752 bp, Zea mays
  misc_feature: Ceres CLONE 1412730-F
  misc_feature: Encodes the peptide sequence at SEQ ID NO. 34261
  misc_feature (457)..(457): n is a, c, t, g, unknown, or other
  misc_feature (458)..(458): n is a, c, t, g, unknown, or other
  misc_feature (463)..(463): n is a, c, t, g, unknown, or other
  misc_feature (482)..(482): n is a, c, t, g, unknown, or other
  misc_feature (505)..(505): n is a, c, t, g, unknown, or other
  misc_feature (558)..(558): n is a, c, t, g, unknown, or other
caaagctggagctccccgcggtggcggccgctctagaactagtggatcccccgggctgcaggaattcgcacgagaccattacctagaacatcctaatcaaaaaataccccgtctcggttctcaaacaccgccgccgccgttctcccgacatctccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactgttgtcttatgaagattggtaaggggagaaagaagatgaggaataaacagcgaaaatcatctgccctcggttctgatggcaggatgtggatcttctttatcttgtattgtatggagcttggnnggggntttttggtctttgtctgcnttccttttccttaaacatcaagncagacagtggtcagacccatggtttatttcagtcctcttcatgcgaccagaanattagaggacatcgagggaggatcatttccgcttgccacctcctcacaaggtgaatcctcgtgcagtgaaaaggaggggacctcgtaaacaacaagggttatagatgataaatctggaggagtcttcagagtaatgcacggttctttcagaatcaatggctggtgtgatcaacaaaaggggaaatgatagctga

SEQ ID NO: 34261 - protein, 49 aa, Zea mays
  misc_feature: Ceres CLONE 1412730-F
  misc_feature (16)..(16): Xaa is any aa, unknown, or other
  misc_feature (18)..(18): Xaa is any aa, unknown, or other
  misc_feature (32)..(32): Xaa is any aa, unknown, or other
MAGCGSSLSCIVWSLXGXFWSLSAFLFLKHQXRQWSDPWFISVLFMRPE

SEQ ID NO: 34262 - DNA, 747 bp, Zea mays
  misc_feature: Ceres CLONE 1412734-F
  misc_feature: Encodes the peptide sequence at SEQ ID NO. 34263
  misc_feature (389)..(389): n is a, c, t, g, unknown, or other
  misc_feature (390)..(390): n is a, c, t, g, unknown, or other
  misc_feature (517)..(517): n is a, c, t, g, unknown, or other
  misc_feature (518)..(518): n is a, c, t, g, unknown, or other
  misc_feature (573)..(573): n is a, c, t, g, unknown, or other
  misc_feature (636)..(636): n is a, c, t, g, unknown, or other
  misc_feature (678)..(678): n is a, c, t, g, unknown, or other
aagctggagctccccgcggtggcggccgctctagaactagtggatcccccgggctgcaggaattcgcacgagaccattacctagaacatcctaatcgaaaaacttgacttcgcttaaaccctgatcctcttcctccctctcctccggtcctcccgcgccgccacccccatctcccaccgcaaaaccttaggtccgacgagcccccgccgttgccgtgggcgccagaagcagccatggcttcgagttcgacgtgtgttcttaagaagaactaccgctgcgaccgctccctgcagcagttttacactggtgggccctttgcggtcgggcttgcccccggcggcgatggcgagggcggcgccgaggctgaggccttcctcgcatgcgctggnngtggagaaggtgcgcgtggtgtcctccgcggacgcctctgctataggggagcccgtcgacggcggactcggaggccatcaccgcggctggcgctgtcccccgactcacggctcctcttttgccgcgnngcacagcagggcttaattagggcctggggacctcgcggtcccgagcttgcatacnccagctggagggggaacatgatgggtcctatcatggccatggcatgccatgggtttcctgggntggtttgcttgcaactggccggagcaaaacagagggctgccntaaggggaagggggaaatgggggaaattttggacccatttccttaaaggccaaaaagggggggttggga

SEQ ID NO: 34263 - protein, 171 aa, Zea mays
  misc_feature: Ceres CLONE 1412734-F
  misc_feature (53)..(53): Xaa is any aa, unknown, or other
  misc_feature (95)..(95): Xaa is any aa, unknown, or other
  misc_feature (114)..(114): Xaa is any aa, unknown, or other
  misc_feature (135)..(135): Xaa is any aa, unknown, or other
  misc_feature (149)..(149): Xaa is any aa, unknown, or other
MASSSTCVLKKNYRCDRSLQQFYTGGPFAVGLAPGGDGEGGAEAEAFLACAGXGEGARGVLRGRLCYRGARRRRTRRPSPRLALSPDSRLLFCRXAQQGLIRAWGPRGPELAYXSWRGNMMGPIMAMACHGFPGXVCLQLAGAKQRAAXRGRGKWGKFWTHFLKGQKGGVG

SEQ ID NO: 34264 - DNA, 679 bp, Zea mays
  misc_feature: Ceres CLONE 1412734-R
  misc_feature: Pfam Name: Utp13 Pfam Description: Utp13 specific WD40 associated domain
tcgaggtcgacggtatcgataagcttttttttttttttttttctgatagcaaatcctacactccaatgcattaaatgcgctgcggccttctaataaacgcagcgaaaaactgcatttacatcaaatgtgattcgtgcgttgggcaacgtctgtttcaacagctgctacaaaattggatgcatgcatgcataagcaaaaccagattctcagctagattttcaggcttcaacagaaacacccttgccaagtccactcgaggcaagcttcatcaccttctcctttccctttttacttgatttgccagattttctcttcttgcttgacttctctggcacaggtgaagcaggctgaggctctacaagttcaccgttctccacagacgaaccattcacccccctctttgattgaccccgcatccacatctgggtctaccacggacattctcgtcagcgtatagtccaacagaaacgtgcttcggactagtctgtccactctgctgaaatgcctctgcgaatacggaataaggccctccaggagctcactgatgccctttatctccaggatatcagtgggagagaaactcctcaatacccgaaaaagcacaaactgcgcaacatgacagaacttgggcttcgtattcccttcacgggcgtactctagaaacacagaaaggccatcc

SEQ ID NO: 34265 - DNA, 695 bp, Zea mays
  misc_feature: Ceres CLONE 1412736-F
  misc_feature (418)..(418): n is a, c, t, g, unknown, or other
  misc_feature (419)..(419): n is a, c, t, g, unknown, or other
tccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcgtatccgactcttcttcgtgtaatgcctatcagnntatgaggttgaacgccttcggaagctctctactagattagtggaaaaaggagacttggtccgagttgacttggggtggaaaattaatgccccgggggccgggtttattccggtaaacaaaaaggggtgcaggaaagggaaggggtattggggggaatggggaaagacaacataaaaaaccccccaaaagaaaccgggaaaaaccccctcggatgtgggggcggggggaattccgccccccgggaattagtcacagataactccacggtgtccccac

SEQ ID NO: 34266 - DNA, 707 bp, Zea mays
  misc_feature: Ceres CLONE 1412738-F
  misc_feature: Translation starting site: 196
  misc_feature (375)..(375): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (411)..(411): n is a, c, t, g, unknown, or other
  misc_feature (412)..(412): n is a, c, t, g, unknown, or other
  misc_feature (435)..(435): n is a, c, t, g, unknown, or other
  misc_feature (452)..(452): n is a, c, t, g, unknown, or other
  misc_feature (469)..(469): n is a, c, t, g, unknown, or other
  misc_feature (470)..(470): n is a, c, t, g, unknown, or other
  misc_feature (476)..(476): n is a, c, t, g, unknown, or other
  misc_feature (481)..(481): n is a, c, t, g, unknown, or other
  misc_feature (489)..(489): n is a, c, t, g, unknown, or other
  misc_feature (490)..(490): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (511)..(511): n is a, c, t, g, unknown, or other
  misc_feature (552)..(552): n is a, c, t, g, unknown, or other
  misc_feature (569)..(569): n is a, c, t, g, unknown, or other
aaaagctggagctccccgcggtggcggccgctctagaactagtggatcccccgtgctgcaggaattcgcacgagaccattacctagaacatcctaatcgaaaaacatcccagtgccgagtgtccccacacaaccaagcggaagcttcggtcgaacagagggagtaagcagttgcgtttcgcattgcgcggcgccgatgggggcgtcggggaagtggatcaagtcgctggtggccctgaaggcgcccgagaaggcggcggggcacaagggcggtcgcaaatggcgtctctggcggagctcgtcggccacgtccagggccagcgccggcgagggcagtgcgctggcgtccgagtcttcttcggcgtcggccgactgnttcactcggcctccnnncgccgtggtccgcgcgcgnncccagggatttcctgctcatcanggcaggaatgggggcgnccgtcgcattcatacgnnctttcngcggnatctttgnngagacnnnnncgttgaagggngctgaggggcatcctccgggtgcaggggcctggttcccggnccgggcccgttggcagncaaattggccgtcacgctccagtggatgccgcacttgtcttggggggggagaaaacccccccccgaaagcccccgccccccttcctccgtttgaggcccccgttcaaggggcccagaaaccgcttcacgggttgggcc

SEQ ID NO: 34267 - DNA, 730 bp, Zea mays
  misc_feature: Ceres CLONE 1412742-F
  misc_feature (389)..(389): n is a, c, t, g, unknown, or other
  misc_feature (412)..(412): n is a, c, t, g, unknown, or other
  misc_feature (413)..(413): n is a, c, t, g, unknown, or other
  misc_feature (591)..(591): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (614)..(614): n is a, c, t, g, unknown, or other
  misc_feature (615)..(615): n is a, c, t, g, unknown, or other
caaagctggagctccccgcggtggcggccgctctagaactagtggatcccccgggctgcaggaattcgcacgagaccattacctagaacatcctaatcgaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtagcagtagaaggaaaagagtcagtccgcccgtgactacnagtgaatttgtttggtggtgggnnttttgtttgaggtcacgatgaatgggaaggcgggcttgttggtggatcaaaaaagcggtggtgttttccctggcgtccaccaactttcgtgggattctcctggcagcagaaacggcgacaagaaccttggggctttcgggtctctgattgggccgcagaacgtcctctggcgaccaantgcgtggaatggggnnnnaaagnncaaatctcgtgggacccgccctccggatagctttcccggaacgcccggggaaggacgacagcggacgattgacgtcgaggaacctcgagggagctggaagcgcccgcaatgtgcc

SEQ ID NO: 34268 - DNA, 758 bp, Zea mays
  misc_feature: Ceres CLONE 1412743-F
  misc_feature: Encodes the peptide sequence at SEQ ID NO. 34269
tcaccgcggtggcggccgctctagaactagtggatcccccgggctgcaggaattcgcacacgaccattacctagaacatcctactcgaaaaaaaaaaaaaaaaaaatagcaaatttctcggcttccgccacacccgctccaggtcccctcccccaaactgaaacgaagttgcggcggtcgcgactgagtgcacaggctgcagttcccggcgctgatgcggcagtggccatcgccgccgctgatcccggcgtccacgctgctccccgtgccggccacctcccaggaggacgagcttctcctctccatggccgagtccgacctcgaggataagctgaacgagatccggaagaccaacagccacctggttatcatcgggaagcccacgggcgacaccaaggaggagtacgacgctgacgtggaggacgacgatgcagacaacgtcgaggagtctgacggcgacgacttcgaccaggagaccggttgacccaggtggctcccccgtgcttcgtcggcgtccttgagcgtcgccatccccgctgtccagtctgtatttcccaatccctgagtggctccttctatctagataccgctgtacccctattttgctgctgcctgttcccaggaatctgagcatggcctctgccgtgggggaccttggggtaggaaacaaagaccatgattaacccggcccaatttaaaacgccatattagctctccttgaaaaaaaaaaaaaaaaaaacctatctccgaacccgccg

SEQ ID NO: 34269 - protein, 89 aa, Zea mays; identical to SEQ ID NO: 25761
  misc_feature: Ceres CLONE 1412743-F

SEQ ID NO: 34270 - DNA, 733 bp, Zea mays
  misc_feature: Ceres CLONE 1412745-F
  misc_feature: Encodes the peptide sequence at SEQ ID NO. 34271
  misc_feature (362)..(362): n is a, c, t, g, unknown, or other
  misc_feature (502)..(502): n is a, c, t, g, unknown, or other
  misc_feature (547)..(547): n is a, c, t, g, unknown, or other
  misc_feature (548)..(548): n is a, c, t, g, unknown, or other
  misc_feature (577)..(577): n is a, c, t, g, unknown, or other
  misc_feature (603)..(603): n is a, c, t, g, unknown, or other
  misc_feature (609)..(609): n is a, c, t, g, unknown, or other
  misc_feature (656)..(656): n is a, c, t, g, unknown, or other
  misc_feature (699)..(699): n is a, c, t, g, unknown, or other
  misc_feature (723)..(723): n is a, c, t, g, unknown, or other
caaagctggagctccccgcggtggcggccgctctagaactagtggatcccccgggctgcaggaattcgcacgagaccattacctagaacatcctaatcaaaaaccttcgccattttcaccaactccctccgatcccggccatggcgggggaggactgccgctccggcgcggaaatggacgcgctcgtacgacgcttgaagctccaccggccgtccccatccccctacgaccccgatccggccgcggcccccgtccccgccaccgccggcgacggcgagctgttccggccgcggagagctgccgtgcttgtctgcctcttccggggagacggcggcgagctccgcgtcatcctcactaagcgntcgtcctccctctccacccactccggtgaagtttcattgccaggaggaaaggtcgaggagggtgatgctgatgatgtagcaacagcgttacgagagtcaaaagaggagattggacttgatccagctctggtaactgtggntgcctctcttgaacacttcttgtccagcatctctggagggggggnnccccggtggtggcatactggtagacagancagcatttaaacctgctcttaatatngctgangtagacgaaatatttgatgtacccctgggagatgtcctcaggatgangacaggacatcggaggagcgagaaagatgggcagacatcacangtcattacttcactatgagacggnatccagagtc

SEQ ID NO: 34271 - protein, 148 aa, Zea mays
  misc_feature: Ceres CLONE 1412745-F
  misc_feature (51)..(146): Pfam Name: NUDIX Pfam Description: NUDIX domain
  misc_feature (121)..(121): Xaa is any aa, unknown, or other
  misc_feature (136)..(136): Xaa is any aa, unknown, or other
  misc_feature (146)..(146): Xaa is any aa, unknown, or other
MAGEDCRSGAEMDALVRRLKLHRPSPSPYDPDPAAAPVPATAGDGELFRPRRAAVLVCLFRGDGGELRVILTKRSSSLSTHSGEVSLPGGKVEEGDADDVATALRESKEEIGLDPALVTVXASLEHFLSSISGGGXPRWWHTGRQXSI

SEQ ID NO: 34272 - DNA, 718 bp, Zea mays
  misc_feature: Ceres CLONE 1412746-F
  misc_feature: Encodes the peptide sequence at SEQ ID NO. 34273
  misc_feature (271)..(271): n is a, c, t, g, unknown, or other
  misc_feature (516)..(516): n is a, c, t, g, unknown, or other
catagctggagctccccgcggtggcggccgctctagaactagtggatcccccgggctgcaggaattcgcacgagaccattacctagaacatcctaatcgaaaaaaccacgatgctctgctcgaccaccgccgatatctatggtcggattaggttcgctgccctcttcgcctcagctgtttcccgaggtctccctgcggcgacggtcaccgtagtggactccggcctccccccacggcgaccgacaaagggtgagagagtgcaagacctacngtacaccggcctcacgaacagcttccttcaccatctctttgatctcatcacggaccaaagtacgggagaactacgcttcaccggctttggcctcttctccaggtataaaattggtcctgaatcctctataacccagggatgaacacggtaaaggttttggatatactactgcgacatcacttggttgtggcactttgcttataggaacggatttccaagggctctgctttatttagtgcactagntgatatgagtgtggcttgccgccactaaagagatctaagaattatcgatttcatttgggaaattaaaccttatgtggcaatttttatttgggccaatgcggcggttggggagtggctaaccccactaccgtgggcccgggagaaatatttatttttcccattttgcaccttccttgagataaaaatttgagagccccctttg

SEQ ID NO: 34273 - protein, 100 aa, Zea mays
  misc_feature: Ceres CLONE 1412746-F
  misc_feature (54)..(54): Xaa is any aa, unknown, or other
MLCSTTADIYGRIRFAALFASAVSRGLPAATVTVVDSGLPPRRPTKGERVQDLXYTGLTNSFLHHLFDLITDQSTGELRFTGFGLFSRYKIGPESSITQG

SEQ ID NO: 34274 - DNA, 589 bp, Zea mays
  misc_feature: Ceres CLONE 1412747-F
  misc_feature (286)..(286): n is a, c, t, g, unknown, or other
  misc_feature (329)..(329): n is a, c, t, g, unknown, or other
  misc_feature (334)..(334): n is a, c, t, g, unknown, or other
tccccgcggtggcggccgctctagaactagtggatcccccgggctgcaggaattcgcacgagaccattacctagaacatcctaatcaaaaaaccaggcaagcaagcgggagccgccaactcgtgcctctcggcagcggcgtctgaactctgaaccgaccgaccgaccgaccgttccgttccgttcaccccaccatggaggcgccgccgggaccgggccatggagtggacgcccactcccgcgccgccgcgcggtgattctcccgcggtaggacagcacaggacgtngaaggggagacgctgtgacggacatatcatctccaccacatcnggcgnaagaacggcgagcccaggcgaccatcagttacatggcaaaacgtggcgtgggcaaaggttcattttggaatcgccttccaggctaaggggctgggaaacaggaaaaaacttcccccctcaaaaggggcttgaaaaaacccgggtaaaaaaaaccgggagttacactttttgggggccaggggaaccccccaagtttttttgcgtgaaaaattggtttttttcaaaaaaaagggggggaaaatttgtgtttttacc

SEQ ID NO: 34275 - DNA, 686 bp, Zea mays
  misc_feature: Ceres CLONE 1412749-F
  misc_feature (63)..(63): n is a, c, t, g, unknown, or other
  misc_feature (287)..(287): n is a, c, t, g, unknown, or other
  misc_feature (290)..(290): n is a, c, t, g, unknown, or other
  misc_feature (626)..(626): n is a, c, t, g, unknown, or other
aaaagctgtggggtcccccgcggtggcgggcgctctagaactagtggatcccccgggctgcanggaattcgcacgagaccattacctagaactcctaatcgaaaaaaatccaagtaaggaaatccccgatgatctcctgcgcgtcgcagcgcccgccactcgattagtggagtccaccaaccaagcacgcgtccctccccgtcccagatcccatcccgcggcagccggtcagtccgatccatctccagtacccagcccgtcacccgccttccccgttcgctctcgtncgngcgcgatggaagtctcatccaaggggttggtccacgtggccctcaaccctgaaagaacccttgaaggaaagggacccggccggccaacacaaaaaggtgccaaggaggagggggcccaaacccccaccaaaaaaacccggggagagaaaccccaaaaaattcggccaaagggcccaggcctcccacaaaaagggggtttcccggaaagccggcacaccaaattgggggggaaaacccttggaggggagtagcgggtttaaaaaaaccttttttaaaaaaaaaaacccccccgggggaaaaaattttttggggaaaaaaaaattttttttttttttnccccgcgtttttttccagggggggagggttttttttttctcttaaaaaaaaaagaaatca

SEQ ID NO: 34276 - DNA, 744 bp, Zea mays
  misc_feature: Ceres CLONE 1412756-F
  misc_feature: Encodes the peptide sequence at SEQ ID NO. 34277
  misc_feature (97)..(97): n is a, c, t, g, unknown, or other
  misc_feature (226)..(226): n is a, c, t, g, unknown, or other
  misc_feature (270)..(270): n is a, c, t, g, unknown, or other
  misc_feature (287)..(287): n is a, c, t, g, unknown, or other
  misc_feature (366)..(366): n is a, c, t, g, unknown, or other
  misc_feature (400)..(400): n is a, c, t, g, unknown, or other
tggagctccccgcggtggcggccgctctagaactagtggatcccccgggctgcaggaattcgcacgagaccattacctaagaacatcctaatcgaanacagacttcaccaactcgtcgacggtagagagagcaagcttcttcggcgatttgagaaaaatcgaggagcgagcgagcgagcgagcgagagaggaggaggaggaactggggcttgagcctgcgcccggnggccccgggtcacggaatcctacccattaccaccctagccttcngttgatcgccgtctcangtcatggcagggccggcgccggatcgggccgccctgactgtggggccgggcatggacatgccaatcatgcacgacagcnaccggtacgagctcgtgcgcgatattcgctccgnaaacttcggggtttgcccgctcatgcggcgacgccgaaacagggaaatcctcggcgtcagtaattcggggggggggaaaaaataaaatgaatggcccgggggaaaaatttaccctaagttctttggggcccctacctttttagggttttaagggggttttttcacccccccccccttggttttgggagggaaaacccccctgggggggactttttttgaggaaattaaaaaaagggggtttccccggaaaaaagggggcgccccctttctcccccctttttttttgagagaacactccccgccctttggggggagggcccccccgttttttataataaaaaaaa

SEQ ID NO: 34277 - protein, 64 aa, Zea mays
  misc_feature: Ceres CLONE 1412756-F
  misc_feature: SWISSPROT Homolog: EC 2.7.11.1 Non-specific serine/threonine protein kinase
  misc_feature (26)..(26): Xaa is any aa, unknown, or other
  misc_feature (37)..(37): Xaa is any aa, unknown, or other
MAGPAPDRAALTVGPGMDMPIMHDSXRYELVRDIRSXNFGVCPLMRRRRNREILGVSNSGGGKK

SEQ ID NO: 34278 - DNA, 716 bp, Zea mays
  misc_feature: Ceres CLONE 1412759-F
  misc_feature (269)..(269): n is a, c, t, g, unknown, or other
tggagctccccgcggtggcggccgctctagaactagtggatcccccgggctgcaggaattcgcacgagaccattacctagaacatcctaatcgaaaagatttcttcttcccatctcccgatccatcgtaacccaaaccctactccaggcagatctccgtctccgccgacgctgccggcgtgagcacagtatcagatccgctgtgatggagttccgtcgtatcctatccaccgcggtgcgtctccttgcagaggatgtcaacgacgctanctaagatgtgcaggccgcttctgttatgatatatgagacctctgtgatcgctccctcctgtgcaaaggcatttgttcttaggggcccgcgcaacggcattagcccattcggtatgggcaacgttttggcccggcccaggggtgaactaaaggaaagggcccacatttccaatatggccttaaccatttaagggaacccatttccggggtcctttttggccgcccccggggggggattttccccccgggaaacccccctaaaaatgaaagggggaaattttattttggttttctgggaaaaagtcttttcttcctccgcggggtaaaagaggggggaaggcgcccaaaaacccgggggttttttttttttacaaaaatcttttttttttttattttggggaaaaaattttttttccccccacaaaaaaatattttgtgttgggcaaaa

SEQ ID NO: 34279 - DNA, 721 bp, Zea mays
  misc_feature: Ceres CLONE 1412760-F
  misc_feature: Encodes the peptide sequence at SEQ ID NO. 34280
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (447)..(447): n is a, c, t, g, unknown, or other
  misc_feature (463)..(463): n is a, c, t, g, unknown, or other
aaagctggagctccccgcggtggcggccgctctagaactagtggatcccccgggctgcaggaattcgcacgagaccattacctagaacatcctaaaaaaaaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgcctcaggaagcgaagtcgaagccgaggccacggcggtacccgaagcagtaccccggcgagtcggtgggcgttgctgaggagatgcgctttgtcgccatgcgcctgcgtaaccccaagcgcaccaccataaagacaagtctggggacggaggacggacgccggnnnncnggggggtgggccgcangggtcgaggcttgaggaagaacgaccgcctggcggcggtgaaggaggaacacgagggaagggaggtattgaggtcgagcctcgaggaaagggggaaatggatgccacccctgggggaggggtttcgatgcgaatacctgttggaaccagcaagctcgtccttcggaaccatcgaaaacgggtccggggccgaaatcccaccgatgtccgcccggtggagtcacagtttctcatccccattctttttgctgggagtgcc

SEQ ID NO: 34280 - protein, 120 aa, Zea mays
  misc_feature: Ceres CLONE 1412760-F
  misc_feature (110)..(110): Xaa is any aa, unknown, or other
  misc_feature (111)..(111): Xaa is any aa, unknown, or other
  misc_feature (117)..(117): Xaa is any aa, unknown, or other
MPLIDAAASAVAPPPPRRVAQLRFFSTRRPGILSLTATSCSPSPPPPVAAEVPAAPQEAKSKPRPRRYPKQYPGESVGVAEEMRFVAMRLRNPKRTTIKTSLGTEDGRRXXGGWAAXVEA

SEQ ID NO: 34281 - DNA, 670 bp, Zea mays
  misc_feature: Ceres CLONE 1412767-F
  misc_feature: Encodes the peptide sequence at SEQ ID NO. 34282
  misc_feature (536)..(536): n is a, c, t, g, unknown, or other
  misc_feature (575)..(575): n is a, c, t, g, unknown, or other
  misc_feature (621)..(621): n is a, c, t, g, unknown, or other
  misc_feature (622)..(622): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
tggagctcaccgcggtggcggccgctctagaactagtggatcccccgggctgcaggaattcgcacgagaccattacctagaacacctaatcgaaaaaaaattaaaacccacacagctatccagcaacagccaggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggcatcgcaccaccaccacccgctgtcccgcctggccgccgcgtcgctagcccgcgcgttgcacctcaagcgccgggaccccaaccaccacagccagaaaggatcaggcggccacccgtcagtaccagcacccgccgcgctgtacccgcacttcctacggcggctacgcccttcacggcgtcgctcggcacgccgccgcagccgctccccgtgctgctcgacaccggagcacccttccaggtgggtgccatgcacctgnaagctacgagtgccgcaactgctcctcccatcgggctcngggcgggtcccggtcttccaccccaagaactcctctctcccggggnnttggtgggctggcgcaacctnnncggggcgaggggtcccactcggccg

SEQ ID NO: 34282 - protein, 175 aa, Zea mays
  misc_feature: Ceres CLONE 1412767-F
  misc_feature (131)..(131): Xaa is any aa, unknown, or other
  misc_feature (160)..(160): Xaa is any aa, unknown, or other
  misc_feature (167)..(167): Xaa is any aa, unknown, or other
  misc_feature (168)..(168): Xaa is any aa, unknown, or other
MAPPPLFPLPPLLILLVIVPLFPTAAPTATTLPLYRHLPHVAEAVASHHHHPLSRLAAASLARALHLKRRDPNHHSQKGSGGHPSVPAPAALYPHFLRRLRPSRRRSARRRSRSPCCSTPEHPSRWVPCTXKLRVPQLLLPSGSGRVPVFHPKNSSLPGXWWAGATXXGRGVPLG

SEQ ID NO: 34283 - DNA, 744 bp, Zea mays
  misc_feature: Ceres CLONE 1412769-F
  misc_feature: Encodes the peptide sequence at SEQ ID NO. 34284
  misc_feature (548)..(548): n is a, c, t, g, unknown, or other
aaagctggagctccccgcggtggcggccgctctagaactagtggatcccccgggctgcaggaattcgcacgagaccattacctagaacatcctaatcgaaaaatttcccactacatcgccaataatgcagctactgcagcagcactgctaccacggccattcccgatgagacgacaaatacaaatgaacaagtccgactcccacggtgtagggtgagtacccgcagtcaccgccacgcgactcgtacggctacgcgatctgaaagacatatcggcagggatgaactccgcctctctgtgcgaagaggggcgccggatatccctaggcttccggctcaccgtggtactccgtccccgcgtcgtagcgcgggacgtctccgccttcctcgccttcgcgctacgcgcgtcctccgaagcctaaggacgcctcactgccctgctgcccaaggaagatgatactgagatgcatgttgatgctgcacctccagcaactcagatgtcaatcagacatgctctgcctgagattcgaatatattgctacttgctcgnactgattttcccttattgatcataagaaatatgatgaggctaaggcatgcgcaagtgtgagcattggtcgcctgaagatctaaaccggagactgttgatgttttggcatcacgacgtacttctattactcctatggggatgaccttaccaacgccttggctgattccgggggaatttgtttggtctacacagatgt

SEQ ID NO: 34284 - protein, 46 aa, Zea mays
  misc_feature: Ceres CLONE 1412769-F
MNSASLCEEGRRISLGFRLTVVLRPRVVARDVSAFLAFALRASSEA

SEQ ID NO: 34285 - DNA, 878 bp, Zea mays
  misc_feature: Ceres CLONE 1412769-R
  misc_feature: SWISSPROT Homolog: EC 1.3.99.5 3-oxo-5-alpha-steroid 4-dehydrogenase
  misc_feature (1)..(1): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (642)..(642): n is a, c, t, g, unknown, or other
  misc_feature (643)..(643): n is a, c, t, g, unknown, or other
  misc_feature (655)..(655): n is a, c, t, g, unknown, or other
  misc_feature (775)..(775): n is a, c, t, g, unknown, or other
  misc_feature (823)..(823): n is a, c, t, g, unknown, or other
ncccgattgggtaccgggccccccctcgaggtcgacggtatcgatattttttttttttttttttgaatcgaaatagtgactgcattcacttcacttctgcgtggacaaatggggataacatcacatgaaccttagactgtattgagacaggacgacgtgagacagtgacataatgctaagaagaagaagaagaaaatgaaatccatctttcggattagaaacttcggacaacggaatccaagttcaaccgctaaacaggcacgattagtacagtacaactgtctgtagacatcgaatcacaatgggccgaccaccaacagtgagccaccaccaccgcctcttcacaggaacggagggagaatcacccaccggcgagggtacttgggcctcccatccttgccgtcaaacagcttcttcagacggctgtgcttgccgagcgcccagttggtcatgatgcccgccgccacgacaaggaagacgtaacctgccacggtctgtgtggcgatgttgaagccgacccactggtagatctcggtggtgtaattggcgcaggtcacgatgttgaacaagaaaccgcgggggatctggtacccgccgctgcgtggccttcctgaaaggttccccccgccttnnngnnnnncnncccccccccccntgggtcctttgtcccttgggcgggccggcccgttctggcgggccctcgtccctcccctccttgggcgggggggcccgcctccccctcggggcgggttgtgggtgggctctccgctgcccnccggcgcgtgggggggtcggggcttcctgttgggggccgttgtttccngttcctgtggtgttcggtccccggccccctcctctgtttggcgcgcgctcccgcc

SEQ ID NO: 34286 - DNA, 694 bp, Zea mays
  misc_feature: Ceres CLONE 1412772-F
  misc_feature: Encodes the peptide sequence at SEQ ID NO. 34287
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
aaagctggagctccccgcggtggcggccgctctagaactagtggatcccccgggctgcaggaattcgcacgagaccattacctaaaacatcctaatcgaaaagttcctcatacatattttggttccaaatcgaataacccaatgccgccgtagccgtctgcctcctcgctttcctttcgtccgtacgccgccggctcgcaccgccgacagtcctcagtccagaactccagatcgaacctccctcttcccagatcgggtcctaggctacagcagccgccgcatccgtcaccttcacaccgcgtgcgtgctctctcttccccccttcccctgtccttgcgacgactgggtgggctaccgccgccttacgcaaggtgccgagagcttcgccgatatctgcgccggagaagagcgcccaccagatcaggcgctgagaaggcgcgctggccggtggatgacgatggcggggtggcggggaactgaaccggtcttcatcgagggggcagctgccgccgcaagaagctgcttgacgatctctgcagccggtccccttctgaatggcccaaggaggaaacctgagtcnnntcgaaacggatccttgtcttggctgagcagggcgcactgggttttcatgaggaacacaacttccgttgagcacaacccccaacctcaagtccctctcccttcaaggactcac

SEQ ID NO: 34287 - protein, 79 aa, Zea mays
  misc_feature: Ceres CLONE 1412772-F
  misc_feature (42)..(42): Xaa is any aa, unknown, or other
MAGWRGTEPVFIEGAAAAARSCLTISAAGPLLNGPRRKPESXRNGSLSWLSRAHWVFMRNTTSVEHNPQPQVPLPSRTH

SEQ ID NO: 34288 - DNA, 726 bp, Zea mays
  misc_feature: Ceres CLONE 1412773-F
  misc_feature (102)..(102): n is a, c, t, g, unknown, or other
  misc_feature (227)..(227): n is a, c, t, g, unknown, or other
  misc_feature (239)..(239): n is a, c, t, g, unknown, or other
caaagctggagctcaccgcggtggcggccgctctagaactagtggatcccccgggctgcaggaattcgcacgagaccattacctagaacatcctaatcgaanagtgtatcgcggaattttttgggttctcgggctccgccgcgatcccatccccatccccgccttgccgttgccgttgccgggcccccccggttctcccggagctttctttctggcccgcgcagtanaagagcaagacngaatttgcgccggcgcctgccccgggcaaaggaaataatcagcactggttgccaaaagcagctccttgacgcaaggctaggacttaaagataacttaatggggcaaacatggaaaattgattatcggaagggccttaccaaacccaaattttttaaggagcttggacccaaaaggggggcccaaaattaaaaggggggggggtaaaaacaaaagaatccccagggggtgggggaaaaaaaagggtggtggaaaccaatcaacctcaaaaaaacctttttggaagaggggggacccttaagggggggggaaaattttggaaaaaaacccctttggggagtaatcccctcacaaaggaaggggggggaaaaaaaaaaaagggcgagaaacaaaaaaattttttttttataaaagagggggcgtttttttttaaagaaaggggcgcgctttttaattaaaaaaaaaattttttttccaaaaaaaaaaaaa

SEQ ID NO: 34289 - DNA, 667 bp, Zea mays
  misc_feature: Ceres CLONE 1412779-F
  misc_feature: Encodes the peptide sequence at SEQ ID NO. 34290
  misc_feature (414)..(414): n is a, c, t, g, unknown, or other
  misc_feature (423)..(423): n is a, c, t, g, unknown, or other
tccccgcggtggcggccgctctagaactagtggatcccccgggctgcaggaattcgcacgagaccattacctagaacatcctaatcgaaaaagaccaaccaaacacacacaactgtagccgtcgtcgtcgttggcgtgcgtgttgctctgctttcggagcccgtgcgcgagcggaaccaaagtaccagaccatggagggcctgctgccgttcctgtaccgggccatcctccacctcgccagcggcgggcagtcgcccatcggcaaccccttcttccgcgacgactcgccgccggagtcgccgctggcggggcactactacgtccgcctcgccgccgggcgccgacgtgccggccttcctctcctccgcggcgcgcggctactacgaccgcgggtgagagcccggccggaccagnaacgacgcntgggcctgggcgtgcgagcaggagaaatcctcgtgggctccttcagttggcgtgttcagagtggctgggtctcctcccctcttcttggggcttccttggaaattcccctccccctccccctcctttggtcctgggaaaaagggcatggatggatggaggcccacccctcccggggggccgggggcgttttcttcccttggaaaaaagggccctataatgggcgggggccccaaaaaaaaaaaaa

SEQ ID NO: 34290 - protein, 158 aa, Zea mays
  misc_feature: Ceres CLONE 1412779-F
  misc_feature (75)..(75): Xaa is any aa, unknown, or other
  misc_feature (78)..(78): Xaa is any aa, unknown, or other
MEGLLPFLYRAILHLASGGQSPIGNPFFRDDSPPESPLAGHYYVRLAAGRRRAGLPLLRGARLLRPRVRARPDQXRRXGLGVRAGEILVGSFSWRVQSGWVSSPLLGASLEIPLPLPLLWSWEKGHGWMEAHPSRGAGGVFFPWKKGPYNGRGPQKKK

SEQ ID NO: 34291 - DNA, 750 bp, Zea mays
  misc_feature: Ceres CLONE 1412782-F
  misc_feature (401)..(401): n is a, c, t, g, unknown, or other
  misc_feature (413)..(413): n is a, c, t, g, unknown, or other
  misc_feature (414)..(414): n is a, c, t, g, unknown, or other
  misc_feature (496)..(496): n is a, c, t, g, unknown, or other
  misc_feature (497)..(497): n is a, c, t, g, unknown, or other
  misc_feature (514)..(514): n is a, c, t, g, unknown, or other
  misc_feature (593)..(593): n is a, c, t, g, unknown, or other
aaagctggagctccccgcggtggcggccgctcttaaactagtggatcccccgggctgcaggaattcgcacgagaccatttacctaagaacattcctaatcgaaaaacattcgaccccagccattccttcctcaccctcgttcaccacacagtccgccacttcctttagtagcttgtgatttgtacgtcgacgagatcacttggtcgggtggcggacgacacacatggggaaggggtagtgtgggtgcatcatggtgggcgttcctcctgctcgccggcgtgctgctggtcgtagcagccacggccggggcggagggacggagtggtcgaacgggaccgcaaggaggacctgcggtggtgcaagcaggcgtgcgagtggcagtacggaaaggacccccgcgnaagagggatgcnnagagcgagtgccgcgagcgcaccagcaagctgacgcgggcgaggacgcgaccagcggcgtggacgcctactctccgctcggnnaaagggcgagtgccggngccagtgcctgcgccgccacgagggcccagccgtgggagaaccaggagtgcatgaagcggtgccgcccccgcggactgnccgtcgacatggagcaagagtccggtcgcggcagccaagagcgcgggcaagtgcccggaagaagtgcaagcgccaccacccccgggaacttggtggaagagccaccccttcctgatgactcaaaaaaacccggaagccggataagaagaaaggcccc

SEQ ID NO: 34292 - DNA, 722 bp, Zea mays
  misc_feature: Ceres CLONE 1412784-F
  misc_feature: Encodes the peptide sequence at SEQ ID NO. 34293
aaagctggagctccccgcggtggcggccgctctagaactagtggatcccccgggctgcaggaattcgcacgagaccattacctagaacatcctaatcgaaaaattcctcttctctcctcccctccctcggcctttctcccatccccgatcaaagaagccgccaataccgcggtagtcgaggatggcgtgggtggcaccacccgacgggcatgaaaaggtgattgctacgctgcagcacatcggcaagtcactcgccagctccaagaacgccgccgacgacatgatccgcatcctctcgggcttggacaactgcctctcgttcatgtccgaccgcttgccgtctcccccagcagccacggttgtcggtaccatcctggaggcgtacaaggtgacccagtggcaggagaacgatgcgtactattaccaagacgaagcctctgcccgacaaaatcctaagagggatgggtgggccgaggtgctgcaacgccgtgatgcccctcctcatggagaatgcgctccaatccactcagggtgaggcgcgggaaaaactcccaccgcgttcgcctggctcgcgggcgccgccggcccgcgggccaggccgccctgcaggccgccatggcggggttcgaagacaagtccgccacctgctcggggggggggggccaccgttcttcccaaaggacctccagcccccctcctccgggggttctcggttacagggg

SEQ ID NO: 34293 - protein, 117 aa, Zea mays
  misc_feature: Ceres CLONE 1412784-F
MAWVAPPDGHEKVIATLQHIGKSLASSKNAADDMIRILSGLDNCLSFMSDRLPSPPAATVVGTILEAYKVTQWQENDAYYYQDEASARQNPKRDGWAEVLQRRDAPPHGECAPIHSG

SEQ ID NO: 34294 - DNA, 666 bp, Zea mays
  misc_feature: Ceres CLONE 1412786-F
  misc_feature (361)..(361): n is a, c, t, g, unknown, or other
  misc_feature (462)..(462): n is a, c, t, g, unknown, or other
  misc_feature (463)..(463): n is a, c, t, g, unknown, or other
cgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcgggctctcagcgacggcgggcagtcccagactcggtgtcggcgtcagcggtcccccttccgcctgtcaccaatcgcctcgcgccctcgcctccggtcctccgcacaccgaccggncgccctgcgtgcacgcctcccgctccctcctgggctcccggtgaaccgtcgacggcgccgggaccccggaggctgcactgcgcgccgcgtgcgaacggcgnntcagcggaagccagcagccgcgccgcttttgggagcgcttatacccgcaaatgaattccttaacggccggtttagcttcttcggggcggttgaaaggggggctaaaaggcccaatttttggaagccggattgggtgagggtcttaaaaaaaaacctgggaatacgggaaaaccccaatggggtgaaaaatttaagtcgcggcc

SEQ ID NO: 34295 - DNA, 655 bp, Zea mays
  misc_feature: Ceres CLONE 1412787-F
  misc_feature (378)..(378): n is a, c, t, g, unknown, or other
  misc_feature (391)..(391): n is a, c, t, g, unknown, or other
  misc_feature (447)..(447): n is a, c, t, g, unknown, or other
  misc_feature (448)..(448): n is a, c, t, g, unknown, or other
  misc_feature (455)..(455): n is a, c, t, g, unknown, or other
gctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcgggctctcagcgacggcgggcagtcccagactcggtgtcggcgtcagcggtcccccttccgcctgtcaccaatcgcctcgcgccctcgcctccggtcctccgcacaccgaccggcgccctgcgtgcacgcctcccgctccctccntggctccggtggnaccgtcgacggcgctcggacccggaggctgcactgcgcagcgcgtgcgaccggcgnncagcggnaggcagcagccgcgcccgctttggtagcgcttatacccccaatgaaatcttttacgtcgcttagctcttcagggggctgaagcgggcgcttagggccgatttttgaaaccggaattggttgaagggtttgacaaagaaacggggaaaatgggggacccccattggatgggaaaaatttttttccccggggaaggacggga

SEQ ID NO: 34296 - DNA, 728 bp, Zea mays
  misc_feature: Ceres CLONE 1412789-F
  misc_feature: Translation starting site: 163
  misc_feature (462)..(462): n is a, c, t, g, unknown, or other
  misc_feature (628)..(628): n is a, c, t, g, unknown, or other
  misc_feature (668)..(668): n is a, c, t, g, unknown, or other
  misc_feature (669)..(669): n is a, c, t, g, unknown, or other
  misc_feature (698)..(698): n is a, c, t, g, unknown, or other
  misc_feature (699)..(699): n is a, c, t, g, unknown, or other
caaagctggagctccccgcggtggcggccgctctagaactagtggatcccccgggctgcaggaattcgcacgagaccatttacctaagaacatcctaatcgaaaaagatagacagaaaggaagaggagaatagcggcgaggacgaagtggcccgcccaggaaatggcgtcgatgcagagctggcgcaaggcctacggcgccatcaaggacaccacaaccgttagcctcgccaacctcaactcggacttcaaggatctggatgtggcgatcgtgaaggcgactaatcacgtggagtgcccacccaaggagcgacacctgcgaaaggttgttgcggcgacatccatcaccaggcctaagggcggatgtcgcctactgcatccacgcgcttgcccgccgtcttgccaagacccgcaactggattgttgctctgaaagcacttgtagtaatccatagacttcttcngtgagggtgatcctacatttcgagaagagcttcttaactttacacaaaagggggcgtattctgcaactttcaaactttaaggatgactccagtccattggcttgggattgttctgcctggtgcgacaatattggttggttttggaagaaaaggtgagggggctcanaagtctgaaagtatgatgtgaaagcctgagcgttgtcaanncaaggtcaggtccctgaaaaggtccagannacccagagagtggatttcacagatctgtt

SEQ ID NO: 34297 - DNA, 728 bp, Zea mays
  misc_feature: Ceres CLONE 1412790-F
  misc_feature: Encodes the peptide sequence at SEQ ID NO. 34298
  misc_feature (548)..(548): n is a, c, t, g, unknown, or other
  misc_feature (728)..(728): n is a, c, t, g, unknown, or other
aaagctggagctccccgcggtggcggccgctctagaactagtggatcccccgggctgcaggaattcgcacgagaccattacctagaacatcctaatcaaaaaataccccgtctcggttctcaaacaccgccgccgccgttctcccgacatctccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactgttgtcttatgaagattggtaaggggagaaagaagatgaggaataaacagcgaaaatcatctgccctcggttctgatgcaggatgtggatcttctttatcttgtattgtatggagcttggtgggttttggtcttgtctgcttccttttccttaaacatcaagcagacagtggtcagacccatgtttatttcagtcctcttcatgcgaccagaanattagaggacatcgaggaggatcatttccgcttgccacctcctcacaaggtgaatcctcgtgcagtgaaaaggaggggacctcgtaaacaaccaaaggttatagatgattatctggaggagtcttcagcagtacatgcactgttcttttcagatcagatggctggtgtggatccacaaan

SEQ ID NO: 34298 - protein, 133 aa, Zea mays
  misc_feature: Ceres CLONE 1412790-F
  misc_feature (74)..(74): Xaa is any aa, unknown, or other
MHCCLMKIGKGRKKMRNKQRKSSALGSDAGCGSSLSCIVWSLVGFGLVCFLFLKHQADSGQTHVYFSPLHATRXLEDIEEDHFRLPPPHKVNPRAVKRRGPRKQPKVIDDYLEESSAVHALFFSDQMAGVDPQ

SEQ ID NO: 34299 - DNA, 674 bp, Zea mays
  misc_feature: Ceres CLONE 1412794-F
  misc_feature: Translation starting site: 344
  misc_feature (387)..(387): n is a, c, t, g, unknown, or other
ggagctccccgcggtggcggccgctctagaactagtggatcccccgggctgcaggaattcgcacgagaccattacctagaacatcctaatcgaaaaacacacaaaccgccgccgccgctaccttcaccactgcggactgcaccagctgcccgccgactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcccctccctcgacgtcgctgctgcctccacttcaccatggcgtttcacgccccggtcctccgttctgaaggactcgctgnaagcgggagtctgggcgcgaaggttcaccaagccaacatccaggcgggccaagggctggtcgctgacatcatacgcacctacattggggtcccagatccatgctgaaaatgcttctggagcctagtggaagggtattgtggttactaaggatggtaatgccattttgagggaaatagacattgcacaccctgctgccaagtctatgatcgaactaagtcgtaacaggatgaagaaattggtgatggcactacatctgtcattgttctagctggagagatgctacatg

SEQ ID NO: 34300 - DNA, 695 bp, Zea mays
  misc_feature: Ceres CLONE 1412796-F
  misc_feature: Encodes the peptide sequence at SEQ ID NO. 34301
  misc_feature (502)..(502): n is a, c, t, g, unknown, or other
  misc_feature (507)..(507): n is a, c, t, g, unknown, or other
  misc_feature (508)..(508): n is a, c, t, g, unknown, or other
  misc_feature (555)..(555): n is a, c, t, g, unknown, or other
  misc_feature (617)..(617): n is a, c, t, g, unknown, or other
  misc_feature (649)..(649): n is a, c, t, g, unknown, or other
  misc_feature (653)..(653): n is a, c, t, g, unknown, or other
  misc_feature (677)..(677): n is a, c, t, g, unknown, or other
ggagctccccgcggtggcggccgctctagaactagtggatcccccgggctgcaggaattcgcacgagaccattacctagaacatcctaatcgaaaagaccgatctctctttccactcctctcttaaaccctagccgctgcgcacaacaacctgctactcaatttgatcaaccgccatccattctcctcctccgttgcagctgcggcatccatccagtagtccgaccaatccatggcttcagcgttcgggaccgcctccacttgcggcattaaacatgcacctgccggcgttgcgcttgctgcgcccatgaagcacctttccctcgtctcgccctcgctggtttcgcttccgcgcaagaatgaggccgcgaaggaagtacaacttcagggtaaacgctgcaaaggagctgcatttcaacaaggatggctcggctatcaggaaaatgcaaaatggggtcaacaagcttgcagaaacttttcgtcgggggttactcttggaccanagggnncgaaatgtagtcctcgaaaagcaagtatggctcacctaaattgtccnaatgatggtgtcactgtggcaaaaaggaggtggaacttgaggaccctgttgaaaaatatggngggcctaaattggtccgccaagctgctgctanacantgggactggggcttggttatgganaacccacactccgtgttg

SEQ ID NO: 34301 - protein, 154 aa, Zea mays
  misc_feature: Ceres CLONE 1412796-F
  misc_feature (91)..(91): Xaa is any aa, unknown, or other
  misc_feature (93)..(93): Xaa is any aa, unknown, or other
  misc_feature (129)..(129): Xaa is any aa, unknown, or other
  misc_feature (140)..(140): Xaa is any aa, unknown, or other
  misc_feature (141)..(141): Xaa is any aa, unknown, or other
  misc_feature (149)..(149): Xaa is any aa, unknown, or other
MASAFGTASTCGIKHAPAGVALAAPMKHLSLVSPSLVSLPRKNEAAKEVQLQGKRCKGAAFQQGWLGYQENAKWGQQACRNFSSGVTLGPXGXKCSPRKASMAHLNCPNDGVTVAKRRWNLRTLLKNMXGLNWSAKLLLXXGTGAWLWXTHTPC

SEQ ID NO: 34302 - DNA, 710 bp, Zea mays
  misc_feature: Ceres CLONE 1412800-F
  misc_feature (189)..(189): n is a, c, t, g, unknown, or other
  misc_feature (190)..(190): n is a, c, t, g, unknown, or other
  misc_feature (337)..(337): n is a, c, t, g, unknown, or other
  misc_feature (438)..(438): n is a, c, t, g, unknown, or other
  misc_feature (483)..(483): n is a, c, t, g, unknown, or other
  misc_feature (497)..(497): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (544)..(544): n is a, c, t, g, unknown, or other
  misc_feature (545)..(545): n is a, c, t, g, unknown, or other
  misc_feature (579)..(579): n is a, c, t, g, unknown, or other
  misc_feature (602)..(602): n is a, c, t, g, unknown, or other
gcggtggcggccgctctagaactagtggatcccccgggctgcaggaattcacacgagaacattatataaaaatcctaatcgaaaaaaaaccctcgtctcgggccactttctcagtcccctctagccgccggctaccgctcgcgctctcctcgcgttcgggaaaggcgtttcgccatggcctcggaaganngagaagatcgccttcacgagaggagattaagcagatgatctctgctccttcatccaaacttctactccacacaaggagatctatcctcagagagctcatctccaactcctccgatgcctggacaagatcagaagtttgaggaaggtntgtgcgaaaagaaacaagctggtgacagggcgcagagctgttcaatccacattgatctcccgaaaagggctgacaacacgctgacaatctcgacaggcggncattggtatggaccaaagtcagacctgtgaaacacttggaccccnattggcgcggccangcacgaaagaaattcatgaggcactttggctgctgnnnngctgagtnntcatgaattggccccaatttttttgggggggccnttttctaactcgccctacctggntgacaaaaaaaaagggttggtcctggaccccctaagccccatgggtgattgagcaatcccgcgggggggaagatccctcaaggtgggggggctcccctcccggggggg

SEQ ID NO: 34303 - DNA, 643 bp, Zea mays
  misc_feature: Ceres CLONE 1412802-F
  misc_feature: Encodes the peptide sequence at SEQ ID NO. 34304
  misc_feature (368)..(368): n is a, c, t, g, unknown, or other
  misc_feature (433)..(433): n is a, c, t, g, unknown, or other
  misc_feature (434)..(434): n is a, c, t, g, unknown, or other
tccccgcggtggcggccgctctagaactagtggatcccccgggctgcaggaattcgcacgagaccattacctagaacatccatcgaaaactaactacttccctgtacgtggacgaggaccaaggagacagagagaaagcctggccgcgccgcccaccgtcgcctcgtcagtcgcctcctccatcctccctccccatcgacttcccaaatcccagccagatctcctcgtcctctggcccattctcttcatctccatgcatggatgaacaagagacggagggagacagatgcaaacatcgagactggggttgttatctgtctttgtagcagaagaaacagtcctaaaaaagatggagagctcctcagatnagaggcaacgttctcaggggaaccacctggggtatgcgagaagcacatccatggattccactggnnctcaagtagctgggagggctagctccatgttgagtaaggaaagtagcaaacggggctcaaggggaatccatcagcctctcaggggaaatgggggactccatactgagctccatgaggcattcccttcagtccgcgggatcaattggtaagaaaatccaaaagttcagttctgggtcactccaccaaagggggccgaggtctatcacccc

SEQ ID NO: 34304 - protein, 64 aa, Zea mays
  misc_feature: Ceres CLONE 1412802-F
  misc_feature (36)..(36): Xaa is any aa, unknown, or other
  misc_feature (58)..(58): Xaa is any aa, unknown, or other
MNKRRRETDANIETGVVICLCSRRNSPKKDGELLRXEATFSGEPPGVCEKHIHGFHWXSSSWEG

SEQ ID NO: 34305 - DNA, 604 bp, Zea mays
  misc_feature: Ceres CLONE 1412804-F
  misc_feature: Encodes the peptide sequence at SEQ ID NO. 34306
tggcggccgctctagaactagtggatcccccgggctgcaggaattcgcacgagaccattacctagaacatcctaatcgaaaaaacgacttcctgcagtcctgcgctgcgcccctcctttccgcctccacgctgccgacgtccaccacacagcacggtcgagtcacccgatccctccatggcggcggcggtggcggcggtcgcggctgccacgacggcggaggacgaggcgcgcctgctgcgtctggaggagcaggcggagcacggcggcggcggcgcctgggactacctctgcctcgcccgacgggtccgcgcccgccgccccgcccacgtcctccgcggcggactcgctctcctcaacaacgcctccgatcgctccggcctcgcctcagaacagaggacgctctacgagcaggtggccacgggggtcatggattgtcagcgtctcgatgtgtgaaaggactgtattgtagtcctttcaaagaaatgtcctgacagcaccccgttatgcccggatagaagttcttctgcttgaagcgaaaagcgaatgctctgaagttgaaagaggttacacgcaaatcctggaaattaatccatttgacctgg

SEQ ID NO: 34306 - protein, 92 aa, Zea mays
  misc_feature: Ceres CLONE 1412804-F
MAAAVAAVAAATTAEDEARLLRLEEQAEHGGGGAWDYLCLARRVRARRPAHVLRGGLALLNNASDRSGLASEQRTLYEQVATGVMDCQRLDV

SEQ ID NO: 34307 - DNA, 771 bp, Zea mays
  misc_feature: Ceres CLONE 1412811-F
  misc_feature: Encodes the peptide sequence at SEQ ID NO. 34308
  misc_feature (1)..(1): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (50)..(50): n is a, c, t, g, unknown, or other
nttttcccccccannnncacacaacccctaaataataaataactcttttntgcaacctgtcgctccccgcggtggcggccgctctattctagtggatcccccgggctgcaggaattcgcacgagaccattacctagaacatcctaatcgaaaaatcgagacaaaatatctaccggggatgtggtggtggatgctcgggcattcgtcaaaccactcatcatcccatcccatcccatccaagggaatccgatcaatcccggactcgtcctcccggccaaccctagcttcccttctcttcccctcccccgatggacccgccgccaaccagggacagaggggaggagctggagcctgaaacccgcgccttccccgacgccgacgacccggagacctcccgatctgaacgcgaagagggtatccctccaccgccaccgccaccgcctctgcgccagcagctcatgtggggcttgccgcgccgacgagcgcctcagggcgcttctcaccctcaacgtctcctgcggggcaagggaacgaccgactcatcccaaaccttgggagaaacttccaggggggccgaaggggggcatgggtcccgggtgtgccccctggggtccccctcggttcccctggggggtgggcaagggtcacaaagggaaagggggcctctttttgggccaataaaatttttaaggggaaagggggagccttggctcttttgggcaatcaatagaagggggggtaacacccttttgtatgggggagaaaagaaacc

SEQ ID NO: 34308 - protein, 31 aa, Zea mays
  misc_feature: Ceres CLONE 1412811-F
MGPGCAPWGPPRFPWGVGKGHKGKGGLFLGQ

SEQ ID NO: 34309 - DNA, 677 bp, Zea mays
  misc_feature: Ceres CLONE 1412812-F
  misc_feature: Encodes the peptide sequence at SEQ ID NO. 34310
  misc_feature (307)..(307): n is a, c, t, g, unknown, or other
  misc_feature (341)..(341): n is a, c, t, g, unknown, or other
  misc_feature (422)..(422): n is a, c, t, g, unknown, or other
gctctagatctagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtgggcgcttcttcttcgggatctcgctggaccgagcggnccagggctagggattcaggcccatggcgtggcgncgcgtcctcacccagatttgcaggcatcgaccagcaaaagcaatctacaatgaactagttgcttcctccccctttggtggntcttcgaagtgacatcacttcagggtgccaggattagacattttacagagaggaacccagtcagttacattggtagcttggcacgccgggtccgaaaactaaaattcacaaagcggaacttctctgcttaaagagatttaaggaaaggacccaaaaggggggcttaacaaaatttggaaagccaactttattaaattcatatccggagaaatttttggggaaaggacagtttcttggaaaggggtgaaaggcgtg

SEQ ID NO: 34310 - protein, 34 aa, Zea mays
  misc_feature: Ceres CLONE 1412812-F
MAWRRVLTQICRHRPAKAIYNELVASSPFGGSSK

SEQ ID NO: 34311 - DNA, 637 bp, Zea mays
  misc_feature: Ceres CLONE 1412814-F
  misc_feature: Encodes the peptide sequence at SEQ ID NO. 34312
  misc_feature (313)..(313): n is a, c, t, g, unknown, or other
ggagctccccgcggtggcggccgctctagaactagtggatcccccgggctgcaggaattcgcacgagaccattacctagaacatcctaatcgaaaataaattctaatcgaaaactcggcctgaatcgaacagctggatcatcaagtactgttgatgctaatgtggatcctactgtattgccacttgaacctaaaggtggccaactgcctttgttcagcagtggtgattggatgtcagacattgattctggatatgaggcagcagaaattgcagcttctactcaaacctcttcgggtgtcacaccatatctgtngtctgctggaagtggttttggcagttcatggatgctgggttatcatgacccatcagatggacccatcacttctgctggtacatcatcgcagcaaaaaagtggacctcaaagcgagcatcagcgggattttaaaccgcctttccgatcttgcggaaatttcccaagtccaaaaacctttttggctggacttttccttctggggaaaataagtcccaaaaaacttccgtaccattcaaagggcccgattctagggaccatggagtgcaaaagcgcaaaaaaaaaattgtccctaaggctggaagaccccatcaagcggttagtatt

SEQ ID NO: 34312 - protein, 135 aa, Zea mays
  misc_feature: Ceres CLONE 1412814-F
  misc_feature (28)..(28): Xaa is any aa, unknown, or other
MSDIDSGYEAAEIAASTQTSSGVTPYLXSAGSGFGSSWMLGYHDPSDGPITSAGTSSQQKSGPQSEHQRDFKPPFRSCGNFPSPKTFLAGLFLLGKISPKKLPYHSKGPILGTMECKSAKKKLSLRLEDPIKRLV

SEQ ID NO: 34313 - DNA, 660 bp, Zea mays
  misc_feature: Ceres CLONE 1412816-F
  misc_feature: Encodes the peptide sequence at SEQ ID NO. 34314
  misc_feature (315)..(315): n is a, c, t, g, unknown, or other
  misc_feature (487)..(487): n is a, c, t, g, unknown, or other
  misc_feature (617)..(617): n is a, c, t, g, unknown, or other
gctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggagggcgncgacaagaaggggaggaagaaggcgaagaagagcgtggagacctacaagatctacatcttcaaggtctccgttctcccccaattcgccttcacctcgccgcttcctcctggccgccaccggttgacgtcgtcttttccggcgaggtagctcgccgggaagacctcacctggnacttttccgacgcaccctccacacactctttacccctccggaatggccgcctgcttctagctcgtcgacgccccaatctccgcttgcttcctcgacagccccatccgcctcttctcgctctcgctacggntcctctgcctgttcgcccatggcgatccgcatcacgtctctac

SEQ ID NO: 34314 - protein, 100 aa, Zea mays
  misc_feature: Ceres CLONE 1412816-F
  misc_feature (52)..(52): Xaa is any aa, unknown, or other
MAPKAEKKPAAKKVAEEEPSEKAAPAEKAPAGKKAKAEKRLPAGKSAGKEGXDKKGRKKAKKSVETYKIYIFKVSVLPQFAFTSPLPPGRHRLTSSFPAR

SEQ ID NO: 34315 - DNA, 652 bp, Zea mays
  misc_feature: Ceres CLONE 1412817-F
  misc_feature: Encodes the peptide sequence at SEQ ID NO. 34316
  misc_feature (490)..(490): n is a, c, t, g, unknown, or other
  misc_feature (502)..(502): n is a, c, t, g, unknown, or other
ccccgcggtggcggccgctctagaactagtggatcccccgggctgcaggaattcgcacgagaccattacctagaacatcctaatcaaaaaacatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggtgattcctgctccaaagcgaggagagatcgttaggcaaatcggtgatgcactgagagcaaagctccatcaccttggcaggcttgtgtcacttgagatggggaaaatcttccctgaggnaatcggtgaggntcaggaaatcattgacatgtgtgattatgctgtgggactaagtcgccaactaaatggatccattataccatctggacgaccaacatatgatggggggggaggggtgctcccctttgggaggttaggggtgttaaaaccgcattaaattcc

SEQ ID NO: 34316 - protein, 165 aa, Zea mays
  misc_feature: Ceres CLONE 1412817-F
  misc_feature: SWISSPROT Homolog: EC 1.2.1.3 Aldehyde dehydrogenase (NAD(+))
  misc_feature (114)..(114): Xaa is any aa, unknown, or other
  misc_feature (118)..(118): Xaa is any aa, unknown, or other
MGAFAKEEHQFLAELGLAQRNPGAFACGAWGGSGPTVTSTSPTNNQVIAEVVEASVHDYEEGMRACFDAAKTWMVIPAPKRGEIVRQIGDALRAKLHHLGRLVSLEMGKIFPEXIGEXQEIIDMCDYAVGLSRQLNGSIIPSGRPTYDGGGGVLPFGRLGVLKPH

SEQ ID NO: 34317 - DNA, 783 bp, Zea mays
  misc_feature: Ceres CLONE 1412820-F
attttccccccacattttcccctccctggatgtatgtggcaccctcttccacacttgggactccaccgcggtggcggccgctctacaatagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggatagtatcccgagaaaagttggagattttgctgggggcaacgcgaccgccaacaagttcctgcacaaggacaggctaaagggtggcccgaggtgcccggacatcgacgcatgctatcagcttctgcagggtattcttatggactccttgcctccgggcttcccaacccccaaccgggttgggttcgttgccccgctaaggtggaggggggtgcccccccgggccccctcaagggatgtgcatttttgggtggaatacacagacagggagggggagaggggggtgggcgaacatactgaaagactctccaacagagactcactacctaaacaagaaaaacaataatagaaaatagtaaacacaccacatc

SEQ ID NO: 34318 - DNA, 648 bp, Zea mays
  misc_feature: Ceres CLONE 1412821-F
gctcttaactagtggatcccccgggctgcaggaattcgcacgagaccattacctagaacatcctaatcaaaaaattgattggttgcttggttgcttgcttcgtttcacgctttccccttcctttgctgagatccaaaagctgagactcagcttgtcgatccatctgttctgtgcgcctactcgtatcttaggatccatctgtatgttgtttacttgttttcctgattgaatcgcgcattggatgcctggtggttggccttgctcctagtcttttcatttacacgagctttcgacgaagccgcgtctggtctgtctgctccatcacaagagcacgcaaatggttcgatctgccgtgccagatgattgctgcattcagtgggacgtcatgcacatccccgatggattggagcgtcagcactctgatctttccttgccgatttggttgtcccagctgagttccccaccccccacaaacatttacaaaagaactggtttggcggggaaattaaagggataaacccccacaaagggggggaacaggggccccccgaaaggactgggggccaatggtggcccggggccgttacccccgggaggggcgggggggagaaaaaggtccccttttctccccagatgtttttcccagaa

SEQ ID NO: 34319 - DNA, 662 bp, Zea mays
  misc_feature: Ceres CLONE 1412822-F
  misc_feature: Encodes the peptide sequence at SEQ ID NO. 34320
aaagctggagctccccgcggtggcggccgctctagaactagtggatcccccgggctgcaggaattcgcacgagaccattacctagaacatcctaatcgaaaatcagttttgattgcagtgcacgtaaatcagttattcctgtgcctggactatgaataggctgtaaatcccctattaatatcactattgctgtcttatactccctccgtcccattatattagtcgttttaggtgttgatttttgtgtctatgttcaaatggattatgatgaatctagacataaatataaaatacatacactaagtattgtatgaatcttataattatctaaaacgaattttaatttgtaatttgagggctcatgttggatttcagctctagtgcacccctacttgctggggatcaatagggtgtttggttggataatgggggtgattgatctttccactccttacattttgtttggttggtggaattgaatgggttgatccatcacaacttcaaccctcacaagctaataattagtatataagcatgaggaatgggttcactctactgaaggttgaacccgcgatgcagcccatataaggcttttgttggtggtgttactgaaggttgaacccgcgatgcaacccatataaggctttttgtggtgttaaatg

SEQ ID NO: 34320 - protein, 52 aa, Zea mays
  misc_feature: Ceres CLONE 1412822-F
KAGAPRGGGRSRTSGSPGLQEFARDHYLEHPNRKSVLIAVHVNQLFLCLDYE

SEQ ID NO: 34321 - DNA, 671 bp, Zea mays
  misc_feature: Ceres CLONE 1412824-F
ctagaactagtggatcccccgggctgcaggaattcgcacgagaccattacctagaacatcctaatcgaaaaacgtgcagccgaacaaagccgcgggcgctgctgttgcgttttgttcccactaccgtccgccacagcctacgcaccttgccggctcgcgggggttttgccgtgcgccttctccctcctcctcgctcgcggcgacgaccgggggaccgcagccaccgtacgccaggtgcgcaggtcttctttgggcccgtcgccggcgacgagcacccaccagggttaaggtcgaagatcagggccgagggacggcggcgcagatgctgatgccagcgctctcagggaggctgctctgaatccgctgcctgtctcgggcatgccagcttgaaggaggaggaaggccaaccaggttcttcatctggaaaacaaagatcccaggttattggaaaaggggttttccctccaaggtgggaaaaaaagggtcctccaggagacttggggggtggatgggttcccacccccaattttgggaaaactccctcctggcccaaatcggggacccttcaggggggccggggatcaaggaggaattccaaattctctttccggaagcgcttttttttgggacagggggcacacgggagagaacacccattctctcgcgtgcag

SEQ ID NO: 34322 - DNA, 844 bp, Zea mays
  misc_feature: Ceres CLONE 1412824-R
aattgggtaccgggccccccctcgaggtcgacggtatcgatattttttttttttttttttctaaaggataagtcaattgcttgcaataatcaagtcccaagacttgtaaagtttacttgtagcatcctacatttacggatcagatgattctatatcctcctacaggctagttttatgaagacgtgcgatcttcattaaagatggactcttcaactgagtccaactgcagtccttacccttttgacaacacggttatactcatagaagcggttcgaatccatgcccattgtcgtatttactgtagtaccacctttgcaagaagtataattcccaccgataatcagatcaaaaccaccaaactctttcaccaagtcttcaatcacatgtgttttgagcttccaaattcctgcatgttgccttagtactccagtttgttcagttttcatccaccaccttcttagaatttttctattcacctcagattcctcaacagatatcacacatttcaaagggatgcctagacgatgaagtgctacttctgcacctccaatgcccctggtagatggataacactcttatttccacctggaaaactaacctttccaggatctttaaaaaaaaaatttgacaagtatttccggggggaaaacgaaattttccgtggaaccaaatccaatcaggggtggggtttaaatcaaaaaaaaattttgggtggggtttatagggggacaccccccgttttttttccccccttttaaaaaggggcccacaaaaggggcccaatacgagggttccccccaccagagccccacatataagggtggttttaaaccccccggcgcca

SEQ ID NO: 34323 - DNA, 1017 bp, Zea mays
  misc_feature: Ceres CLONE 1412827-R
ttggattcgattggggtccgggccccccctcgaagtcgtgggtatcgataagcttttttttttttttttttaggagaagatgttggtagttctttagttcctttgcctttacagtgtacaatagtttattcaacttacaatgctacaccaaattagctgctcacaccgcaaaaaaagagtcatctatccctacctcaagaaacaagttcatgtaggcaacaggggttgcctctcatcagttccaatcctatggctcgcatcgacagcagatccagcagtcatatttacaaaagaagattcggagtgaccggtgattttgtgtgtcttccaactctataaagtcagctggtttgtcatctttgactttagcaagtggagagataaactggtgcattgaaataaacaccactgtattccccccccagaaaataaatggggcaaggtatgccccctaaaatgccggcagaagcttggcccgggaaatatcgaggggaacattgtggacggagtcctttctgtgcaaaattctggtcttggcttaccttgccaagcagctaattgaagaaatagaatgggcccttggggggtgtgggtgtaatttacccttggggcagaaagaagcctccgctggggctccctttcagaattgggtgtcccgggtaagagggatgtgttgtgaaaaactccgtctctatggcgccccttttgggtaaattaagagggggaagttcgccgtggataaatatgccttcactgcgagggggttgaggagaaaatggggcgttccgatataggcccttcttgcagaaaagacgaggggtggtcttatgaggaataatattgccgagaggtgttgggagtaagtggatgctttttgtcgtaggtggtttttcttcaaatgttcatgcaaccttgactgtgagtggtggttgggtagattgttcttccgtcatatcccctctgtccagcgcatattgttgactcgcacgttcggtggtgtgtgtggtagttggttgg

SEQ ID NO: 34324 - DNA, 697 bp, Zea mays
  misc_feature: Ceres CLONE 1412833-F
aaagctggagctccccgcggtggcggccgctctagaactagtggatcccccgggctgcaggaattcgcacgagaccattacctagaacatcctaatcgaaaaaaggcccaactccactcatcgccactgcgccgaaacccaaagcggggaggaggagcggaaaagaaaaggaaaatgggaggagcggaagcaagtccgagcaagtcagaggatccgccggcctatctccgcctataaaatgccgtcccaccccccaccttcctagcagctgctctccaccaagagctgctggcaccaccaaagcaatcgctggatttgtcccgagtatttccgggctcaccgccctaaatctgacccgatatttcccccccccccctgagggggggggggggggtgtagccaacgacaaatgggcgccccggcgcgggaaaaaaccatgcagccggctgggggacccccgcgctccacctcccgggtggccgcgcctccctccccccccgtggttccacttcaacccgccatgatcggctagccgggctattgggggggggtttccttgcacgatcacgtgcgggtggggcgtcgggccttgcgcacgcgcaagtccaccggccccttaaaaactgagagccgggcgcgcccatggagcgcggaccagtggcgccgccatgctcgtgtggtattttgttcgttcgtc

SEQ ID NO: 34325 - DNA, 783 bp, Zea mays
  misc_feature: Ceres CLONE 1412835-F
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (20)..(20): n is a, c, t, g, unknown, or other
  misc_feature (48)..(48): n is a, c, t, g, unknown, or other
  misc_feature (50)..(50): n is a, c, t, g, unknown, or other
  misc_feature (52)..(52): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (678)..(678): n is a, c, t, g, unknown, or other
  misc_feature (679)..(679): n is a, c, t, g, unknown, or other
  misc_feature (681)..(681): n is a, c, t, g, unknown, or other
  misc_feature (684)..(684): n is a, c, t, g, unknown, or other
ttttttgtccnnnngccccnatgattttcttttttttttttttattantntnttatttgggaggtggaagtggtggggggcgctctagactagtggatcccccgggctgcaggaattcgcacgagaccattacctagaacatcctaatcgaaaaagcactgcactgcacgcctccgccatactgcgacgccgccgtgcatcgcttcacgcagagcagtgatggaatcccatcacggcggcgacgggaaggcgcgggacaagttctcggtgtaccagaacccgtccctcacccgcgccctagactcccgcagcgcccgcccctccgtcacagtcctcctccgtcctcgcggtcatatccgtcgcctccgcatcctccttcctcgccctcacctcccgggaggagcagctcaccaagctcgccggacgagcgggtatctctgtccttgctggtgttttttgcattagggtggcggaaagcagcacccgggctttggttgactatttcacactggcggggggtgccttcagggcaactgaagggaataaaaggggcaaacaaaggactggcccaggccgaacaggttgtccttggcgacccacaacggggtttctggccaaagcggcgataaagggggaagggaaaaagcccacagaacggaaggaggggnnnnnnnnncnncnganccccaccgatatccacccgtatactagaactgtaggcggggacagcggttggaggccgtctattgaaacaaaccaacaaaacgaacgcaccacacccat

SEQ ID NO: 34326 - DNA, 630 bp, Zea mays
  misc_feature: Ceres CLONE 1412837-F
  misc_feature: Encodes the peptide sequence at SEQ ID NO. 34327
  misc_feature (329)..(329): n is a, c, t, g, unknown, or other
  misc_feature (410)..(410): n is a, c, t, g, unknown, or other
gctctagaactagtggatcccccgggctgcaggaattcgcacgagaccattacctagaacatcctaatcaaaaatttccggcctccgcttcccatcccgatcagcctgccgcagtgccgctccttccctccctctacccgtcgccgctgctgccatggacgaagtcgtcagccagattttggagaagcaagtgctgtctgccgcgaaggcggtggaggacaagctcgatgaggagatcgccgcgctcgaccgcctcgatccggacgacatcgaggcgctccgcgagcgccggatccagcagatgcgccgcgccgccaagcgccgcgccnagtggcgtgcgctggggcacggggagtacaccgaggtccccgagaaggagttcttctccatcggccaggccagcgagcggntcgtctggcacttctaccgcgacaactggccctgcaaggtcgtggacaagcacctgtccgctctggcaaaacagacggggaaaaccgggtcctggaagtccacccccaagaagccccccttctgacagaaaaattcaggaaaatcctccctcccaaccctccccttaattaaaaaccccagggcgagggaaacctgggggcggtttcgacaaggtggggg

SEQ ID NO: 34327 - protein, 126 aa, Zea mays
  misc_feature: Ceres CLONE 1412837-F
  misc_feature (59)..(59): Xaa is any aa, unknown, or other
  misc_feature (86)..(86): Xaa is any aa, unknown, or other
MDEVVSQILEKQVLSAAKAVEDKLDEEIAALDRLDPDDIEALRERRIQQMRRAAKRRAXWRALGHGEYTEVPEKEFFSIGQASERXVWHFYRDNWPCKVVDKHLSALAKQTGKTGSWKSTPKKPPF

SEQ ID NO: 34328 - DNA, 651 bp, Zea mays
  misc_feature: Ceres CLONE 1412839-F
  misc_feature: Encodes the peptide sequence at SEQ ID NO. 34329
tcaccgcggtggcggccgctctagaactagtggatcccccgggctgcaggaattcgcacgagaccattacctagaacatcctaatcgaaaaactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcaatgccgcggagtctccgatgacgaccacgaggacgtggaggaagtggaacttgaggaggaggaggacgactagaaggatctcgaggcaatgcgacggtccgaggagtaggagcgccgcgagcataaggccgagactaagactcgccgccgccggagacggaccaagcgccgccgcgacccggggagcgaggatgaggaccccgaggagctacagctgcaaacgagaggatccccgtgaaggagagatcacgaaggcgttgcccgtacctgtagaggaccctggccaaaatcactggcaagggtaagaagaa

SEQ ID NO: 34329 - protein, 69 aa, Zea mays
  misc_feature: Ceres CLONE 1412839-F
MGRRRRFAQLDDDDDDDEDVPINFKPSGGASSSDAKPRKPQPPPQQCRGVSDDDHEDVEEVELEEEEDD

SEQ ID NO: 34330 - DNA, 767 bp, Zea mays
  misc_feature: Ceres CLONE 1412840-F
  misc_feature (597)..(597): n is a, c, t, g, unknown, or other
tatacccaccccccccccctaaatattattttttttgggccccgcaaaaaaaaagcggaagtccccgcggtggcggccgctctataatagtggatcccccgggctgcaggaattcgcacgagaccattacctagaacatcctaatcgaaaaaaaatcaaatgattccttgcttgcccccctttccctccaaaattctcgctgcggccctcgtcttcctcctcttcttcttctgtaaagtgccaagtgccaactgcattctggcttacttggaacaccactccttgattccttcccattccaccagtctcatcttgcatagtgctagaacttatccatttgcttgctactgctcttgcccagcatgagcaaacggccgatgatgacaacgccggcgggcggagaagacggtgagccatccagcggcgctcgcggagccggtgcgccgccgccgtctcagccggtcggtaccggccgctacgcaagactgcagagcgccggcaccgggaccagtgccgccgacggcgaccggcccagacgtcatgtgacttatatggaaggccgtttttgaagcggcggaccagccgccaaccgatgancgtttacgggtgcccggggacacgggcccccgccccagaacgcgcacggaaacggccccagggacgacctaacacgcccctgttggtcgcaaaaaggagaaccaagaaacccggtccaatttgaagaaaccaaccccaccggtattggtaacggaaaaaactaaccccgc

SEQ ID NO: 34331 - DNA, 630 bp, Zea mays
  misc_feature: Ceres CLONE 1412842-F
  misc_feature: Encodes the peptide sequence at SEQ ID NO. 34332
  misc_feature (311)..(311): n is a, c, t, g, unknown, or other
  misc_feature (312)..(312): n is a, c, t, g, unknown, or other
aaagctggagctccccgcggtggcggccgctctagaactagtggatcccccgggctgcaggaattcgcacgagaccattacctagaacatcctaatcgaaatctagaaatccacttcgattcgccctggacgctcctgcctcctgctagtcgacgcgcaatccttggcaatctggcagacaggtgaggcgctgagcctgctactactaactaggagccgcggcgggaaatgagggatgcggaggcggcgtcgcgccggcggtggacgctggtgctggtgaacatggcgtcggtgctggagaaagcagacgnnagtgtgctgcccgccgtgttacaagaggtgggaaccgggtttggggctttctccgacggggttgggttccctcaccctctgcccggggggtctgcaagggcggcttggtaacccgtttcgccgctaagccctcccggggccagattggggccctggtgctcccccccgtggaaaccctttcccttgggccgccgcaccctttttcggggggcggtgttccggagtttctcccccaaaggggaatttcccggggggcctcaacgggaatggggttcccgcgggggcccccccccgggagataaattctttttgccccca

SEQ ID NO: 34332 - protein, 64 aa, Zea mays
  misc_feature: Ceres CLONE 1412842-F
  misc_feature (28)..(28): Xaa is any aa, unknown, or other
MRDAEAASRRRWTLVLVNMASVLEKADXSVLPAVLQEVGTGFGAFSDGVGFPHPLPGGSARAAW

SEQ ID NO: 34333 - DNA, 614 bp, Zea mays
  misc_feature: Ceres CLONE 1412843-F
  misc_feature (110)..(110): n is a, c, t, g, unknown, or other
  misc_feature (226)..(226): n is a, c, t, g, unknown, or other
  misc_feature (227)..(227): n is a, c, t, g, unknown, or other
  misc_feature (230)..(230): n is a, c, t, g, unknown, or other
  misc_feature (232)..(232): n is a, c, t, g, unknown, or other
  misc_feature (233)..(233): n is a, c, t, g, unknown, or other
  misc_feature (348)..(348): n is a, c, t, g, unknown, or other
cgctctagaactagtggatcccccgggctgcaggaattcgcacgagaccattacctagaacatcctaatcgaaaaaagcatagggacattgcattggggaactacagaanagggtccgaatcgaatccgtggtgcactgccccttcctcccccacaagccgccgccgccgccgtgaggactccggcgaatggcgtcccgcgtcgcctcgggcctctccccgcgcgnngcngnngcacactaagccctctaaaggagtatgcacatgtcagaagctaccacagtcaactttcagctttggtttcctgctacatctgaatgctcaaatcttgcgaggagatgctataacntacctaatccctctccaatacaagtttggaggaagggcatttgcttcaaaacacgaaaacaaggttgagggtgtgggggccctttcggggggaaaccggaaatggggggaacccttggtaacttctaaaaaaaaaccggaaaaaaaaagccggggttggggaaaccataagcgcaaattgaaaactgaaaggccccaaaaaaattgccccccacccccgggggggggtgggttttaaaaaaaaaacccttttggtgggggaggggc

SEQ ID NO: 34334 - DNA, 642 bp, Zea mays
  misc_feature: Ceres CLONE 1412847-F
  misc_feature: Encodes the peptide sequence at SEQ ID NO. 34335
  misc_feature (414)..(414): n is a, c, t, g, unknown, or other
  misc_feature (493)..(493): n is a, c, t, g, unknown, or other
  misc_feature (606)..(606): n is a, c, t, g, unknown, or other
cgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcnggcggcttcggtgtaggcctgggcagacttgggtggcggtggccgcatccggccggcggaggactcggcttctcgtccntctgggcggtggtgggcacggggcttctatcccacaattatcttctcagagcagcgcacctcagtactctttcttatggtgggatatcagggtacaagcaaaaagatgaattncaatgggaaaggggttggtgttatcattggaaaagc

SEQ ID NO: 34335 - protein, 145 aa, Zea mays
  misc_feature: Ceres CLONE 1412847-F
  misc_feature (84)..(84): Xaa is any aa, unknown, or other
  misc_feature (110)..(110): Xaa is any aa, unknown, or other
MADDHYSSKRKYDDPSPPPRRTGFSSGPPPASPLAGGAPSYNSVPPPPDEIQLAKQRAQEIAARIFNAAEAKRPRVDNGDDDSXRLRCRPGQTWVAVAASGRRRTRLLVXLGGGGHGASIPQLSSQSSAPQYSFLWWDIRVQAKR

SEQ ID NO: 34336 - DNA, 751 bp, Zea mays
  misc_feature: Ceres CLONE 1412848-F
  misc_feature: Encodes the peptide sequence at SEQ ID NO. 34337
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (418)..(418): n is a, c, t, g, unknown, or other
  misc_feature (421)..(421): n is a, c, t, g, unknown, or other
  misc_feature (428)..(428): n is a, c, t, g, unknown, or other
  misc_feature (442)..(442): n is a, c, t, g, unknown, or other
  misc_feature (447)..(447): n is a, c, t, g, unknown, or other
  misc_feature (487)..(487): n is a, c, t, g, unknown, or other
  misc_feature (511)..(511): n is a, c, t, g, unknown, or other
  misc_feature (512)..(512): n is a, c, t, g, unknown, or other
tggcccccccncnncnnnnnnnnctccntncannnnnntcacnnnnnnccaaagctggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcgncgntggtggnggagcgcgtggcgntgaanctcagggggtacttcgacctcgccaaagaggagatcgacnaggccgtgcgcgctgaggagtggnngctccccgacgaggccaccgcgcactaccgcaacgcgatgggggtcatgctcgagggccaaggcggggggcgtccccgatgccgtctcctccagggaaagggggaagggcaggggggaaccgggaaaaaatcgcaaggggaaggcccagggccggggaggggttaaaaggggtggggaaaaaaaaggggaaagggccctgggtggcaaaagggcccaaaaaggggggggcaacaaccct

SEQ ID NO: 34337 - protein, 121 aa, Zea mays
  misc_feature: Ceres CLONE 1412848-F
  misc_feature (36)..(36): Xaa is any aa, unknown, or other
  misc_feature (37)..(37): Xaa is any aa, unknown, or other
  misc_feature (39)..(39): Xaa is any aa, unknown, or other
  misc_feature (44)..(44): Xaa is any aa, unknown, or other
  misc_feature (45)..(45): Xaa is any aa, unknown, or other
  misc_feature (59)..(59): Xaa is any aa, unknown, or other
  misc_feature (67)..(67): Xaa is any aa, unknown, or other
MSFLRSLADSFSSLLFSSGGGAVSMDAAGAAPSPAXXVXERVAXXLRGYFDLAKEEIDXAVRAEEWXLPDEATAHYRNAMGVMLEGQGGGRPRCRLLQGKGEGQGGTGKKSQGEGPGPGRG

SEQ ID NO: 34338 - DNA, 703 bp, Zea mays
  misc_feature: Ceres CLONE 1412849-F
  misc_feature: Encodes the peptide sequence at SEQ ID NO. 34339
  misc_feature (593)..(593): n is a, c, t, g, unknown, or other
cgcggtggcggccgctctagaactagtggatcccccgggctgcaggaattcgcacgagaccattacctagaacatcctaatcgaaaagaggcctcgctctggttggaaggtttggagaaactccccggctcgaggagatcgtgacattgagaggacgatgggagggcgcgcgcgcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatgccctctttgttagtgagaaggcaagggaatacgccataatcaaggagcttgatgagccagttaccttagaggaggggacaggggtcctgcaagtttgaaggggaaaattcagaagggccttggaagggggagggggcctatttaaagaacctccgccccacaggagggtggggagggaatgcccagggggttttggaaaagggaacccccaaccacatttttgggttgggcccaaaaaaaggggggggaacnaccacaaaaggggttttttttccctctttaggcacaaaaaactccaaaagtggggaaaagttttgtttaaatcttttttttaaaaaccccccccccgggggcgcaaatag

SEQ ID NO: 34339 - protein, 93 aa, Zea mays
  misc_feature: Ceres CLONE 1412849-F
MGGRARLLLLLVSALVFQIHASDPLLYEPFDEDFEGRWVVSKKDEYQGVWRHAKSDGHEDYALFVSEKAREYAIIKELDEPVTLEEGTGVLQV

SEQ ID NO: 34340 - DNA, 672 bp, Zea mays
  misc_feature: Ceres CLONE 1412850-F
  misc_feature: Encodes the peptide sequence at SEQ ID NO. 34341
  misc_feature (214)..(214): n is a, c, t, g, unknown, or other
  misc_feature (493)..(493): n is a, c, t, g, unknown, or other
  misc_feature (672)..(672): n is a, c, t, g, unknown, or other
ggagctccccgcggtggcggccgctctagaactagtggatcccccgggctgcaggaattcgcacgagaccattacctagaacatcctaatcgaaaaattgttgattgattgatcctccccgcctcactcctttgtctcctcgcctcgtgctcgctcgctcccctcgccctggcgaggagggcagcagaaaccctagcggctcaggccgggcggnggttagatgctccaaggttcgagagggaagggtaggttagtggtgcgccatcgactatgggctgcgtcttcgggcgggcggctgcgtcgtcctctgcagcgccgaagaagaatgggcaaagggggaaggccctcccccgcaacccgaaatcggggtcgcccctcccgcagtcggccgcacccaaagggaaaaccggaggcccgcggcggcggaatcggggggccccaagggcggccgggaaccccgagaaggcttgaggtcccccctggctgccgcggngggaacagttccccgccccggtgggccaccccggggtctcccccaaaccccccgggggaggccccccccccccttggggccccccggaaggggcccaaaaactttttgaaaagggttaaaaaaaaaaaggggcgggggaaaacaaaaatagaaactggtgccccgggggaaacgccccn

SEQ ID NO: 34341 - protein, 66 aa, Zea mays
  misc_feature: Ceres CLONE 1412850-F
MGCVFGRAAASSSAAPKKNGQRGKALPRNPKSGSPLPQSAAPKGKTGGPRRRNRGAPRAAGNPEKA

SEQ ID NO: 34342 - DNA, 646 bp, Zea mays
  misc_feature: Ceres CLONE 1412853-F
  misc_feature: Translation starting site: 465
gctcaataactagtggatcccccgggctgcaggaattcgcacgagaccattacctagaacatcctaatcgaaaaattatcgatcccagccccaggccatgccgaccaggtgctaggaggtcgctgctctgggtcgacgtcgcccagttcctgaccctgtgcgtcgccaagcatctcgcagcgataggcatacgagaagtcctacattgtgtatcggggatcacatgcatatgcccgtgatgcatcggtcggaggagcttgctcgcgcaatccaggctcaccacgacctcctggcatctatactcggcggggacgacgaccaccaccatgatacggcgctgctagtacatcttctactcctacaccaagagcagcatagatggattctgagtgcacctaggaggactcgcgcgctcagcagatcgagaccaaccctgaggggggtgccgttggctggagagcaagatgctcaagctgcacaccacgcggtcctggtacttcatggacctggaagcgcgacggtcacgtccatgcctggctccatctggaaccacggttaggttcggaacaggacgtcttcatcgtccatctccgaactgcgaagtgtggcccctagtctccacaacttccaagtaaaacgctggaaa

SEQ ID NO: 34343 - DNA, 677 bp, Zea mays
  misc_feature: Ceres CLONE 1412856-F
  misc_feature (331)..(331): n is a, c, t, g, unknown, or other
  misc_feature (366)..(366): n is a, c, t, g, unknown, or other
  misc_feature (397)..(397): n is a, c, t, g, unknown, or other
  misc_feature (405)..(405): n is a, c, t, g, unknown, or other
  misc_feature (406)..(406): n is a, c, t, g, unknown, or other
  misc_feature (411)..(411): n is a, c, t, g, unknown, or other
  misc_feature (452)..(452): n is a, c, t, g, unknown, or other
cgcggtggcggccgctctagaactagtggatcccccgggctgcaggaattcgcacgagatcattacctagaacatcctaatcgaaaaagaggcttttctcaaaaacgcgccgtcgccgtttcttccccctttttctttgagaaaattcgcccgcgagatctttagtttcagaccccgtgtggattagtcgctgtcacgatcgaggcgggacgccaattgcggtggccaccacctccaatccactccccgcggtgacctcgccgagctgttcttgctccgtcctccctccactcctagatttgtttcgcacccgattcctgagcttccgcgncgcttcttgctgaaaagaagctcccgagtctcagntctggatcgatagagagcgggttctttgcgncctctganngtcgntcccgctcttgatttgcctcacgaccaatcagtgggctgcngcctagaggctggacgaaaaatttgctaaaggaatggggccagggttaaaaaaattccccctccggattgggaggggagggcccctggggttgggttattttaaacggggagggcgggcaacaccttctggttacccccccccaaggggggcgggggtggggaaccccgcggggaaaaaccccgcggggcccccgtgggggggggggccaaaaacccggggattc

SEQ ID NO: 34344 - DNA, 618 bp, Zea mays
  misc_feature: Ceres CLONE 1412858-F
  misc_feature (161)..(161): n is a, c, t, g, unknown, or other
  misc_feature (314)..(314): n is a, c, t, g, unknown, or other
  misc_feature (333)..(333): n is a, c, t, g, unknown, or other
  misc_feature (334)..(334): n is a, c, t, g, unknown, or other
  misc_feature (353)..(353): n is a, c, t, g, unknown, or other
tggagtccccgcggtggcggccgctctagaatagtggatcccccgggctgcaggaattcgcacgagaccattacctagaacatcctaatcgaaaacttggatagtccgtagccgcttgccctgttcgcatcttcgcgcgtggcgcacaccgctccagctcntccttcgacgggcacggccgagccgccttctcttgccgcagcgggcgcgctctccatggcgcctaattagcctagccgcaacgcgcgcccgtgctgcgaagagggtgtaaagtttgtatatgatgccaggcatggatgaaccccttcttggcnatggtcttaagaacagcgnnaaaagagagagcctggtantggccgaggtcaaaaaacgaatgtacttggctgggccactcacgctgcatggatcctaccgaaactttggcaaaatgaattctattagggttggccgggcccccttgggaaggttggcccttcccggggcccccttcccccccccctttggagggggaacggggttcccgttatttggcggggaggggaaaaaatttgaaccacttgggggggaaatttttctgggaaaaaaaaaaatttctttttggggatttacaaagaaggg

SEQ ID NO: 34345 - DNA, 701 bp, Zea mays
  misc_feature: Ceres CLONE 1412863-F
  misc_feature (494)..(494): n is a, c, t, g, unknown, or other
  misc_feature (498)..(498): n is a, c, t, g, unknown, or other
  misc_feature (506)..(506): n is a, c, t, g, unknown, or other
  misc_feature (661)..(661): n is a, c, t, g, unknown, or other
  misc_feature (666)..(666): n is a, c, t, g, unknown, or other
  misc_feature (670)..(670): n is a, c, t, g, unknown, or other
tccccgcggtggcggccgctctataactagtggatcccccgggctgcaggaattcgcacgagatcattacctagaacatcctaatcgaaaaaactttagcagcaaaattcacccaaaagaaactcctgataaatagaaaaaggagggaaaaagaaaaacacttgcagcggcatccaccaccgaagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgaatcacctcggcggcggcccgctggttgctgcgcggtccagcacccgntcgnagtggggnggtgttttgtgttctttgagtttcaaggatttggttttttggttgcgttcttgggggagacgaaggggactaaggcgccagtgagcgggacaagaatcagcatggatcccgaggcggcggtcagttttccaactcttggcgggcgcgcggcgggncccgnccgncccgcaaaatgctggctctttcggggggggg

SEQ ID NO: 34346 - DNA, 672 bp, Zea mays
  misc_feature: Ceres CLONE 1412866-F
agtggatcccccgggctgcaggaattcgcacgagaccattacctagaacatcctaatcgaaaaactgcgatgtggtcctctcctccttatcacctgacctccacacacacacacagaccgacaggcacgcgcaagaaaaaattcattcatatatcgcacgctcgatcgttgacgatctcccccatcactgcacggcgcggcgcaacaagagcgagggattgaagctcaactagtcgtctaatcggctagtaagtacgtgtagctaggctgcgctgcaccacctgccgtgcatgcagcgcatggcgcacgagggctctgaggcctccgtcgccagctccgcgccgcgcaaaccgtcggccgtcggcctcctcctggagatgcgacatgaagaacccggctgcctacggtgcgtggcctccggccccccgcggagaggtggccgccacggaccatcgatgtcgccgtcagcgcactccatcatctgatcacaacggcaggggctgggacagacgaccatctgaggctacctggacccacaaaccgcctgagaaaacgtccattacctgcccattttccgggttcgggagccacgccagaaaccccgcgagggggagatttctaaagagggggtagaaacaaagaaacaaaattttaacaggtttttggaaatcc

SEQ ID NO: 34347 - DNA, 648 bp, Zea mays
  misc_feature: Ceres CLONE 1412870-F
  misc_feature: Encodes the peptide sequence at SEQ ID NO. 34348
  misc_feature (422)..(422): n is a, c, t, g, unknown, or other
cgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctncgccgccggtgagttcaacctgcctcccccgccgccgccgccgaaggccaaggaaacaaaggtggaggaagccaaggcccaggtggctgcggatgccccgggttgaggaggtcaaagacggaggtgccgcccggccgaggaggccaaggctgagacactgggctgaggaagccaagccttccgagcccgagccgcaagagaaaaaactgtcgtggtcacctgaaag

SEQ ID NO: 34348 - protein, 97 aa, Zea mays
  misc_feature: Ceres CLONE 1412870-F
MAEETQPEAAAAAAPAAAEVVVTEAAPAEAEVPAAAEAEAEAKDEKKGDEAELTADDAGVGTGSFKEESNLVEDLPDPEKKALDEFKQLIAAALRRR

SEQ ID NO: 34349 - DNA, 663 bp, Zea mays
  misc_feature: Ceres CLONE 1412873-F
  misc_feature: Encodes the peptide sequence at SEQ ID NO. 34350
ggagctccccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttcgggtcggaggtccgctctggcaacctgaagaactcggcctcatccgcatcatcgactacacttgcaacgtcgtcaaaggcaaagatgacaaggtcgttgggtgtcatcaaatgcgaacctgtggtgccagggcttgacccccaaaatcaacggcgaggccaaaaaaaaaggagcccccatgggggctgaaccctaaggaccaaagggatgggccggaaatccccacctccctttgaaccccaagcgggaggggaaatcctggctc

SEQ ID NO: 34350 - protein, 127 aa, Zea mays
  misc_feature: Ceres CLONE 1412873-F
  misc_feature (6)..(108): Pfam Name: Rep-A_N Pfam Description: Replication factor-A protein 1, N-terminal domain
MDAAKLVTPVAVSHILAHPSAGSDGAVTDLVVQVLDLKSVGTGSRFSFTATDGKDKIKAMLPTNFGSEVRSGNLKNSASSASSTTLATSSKAKMTRSLGVIKCEPVVPGLDPQNQRRGQKKRSPHGG

SEQ ID NO: 34351 - DNA, 600 bp, Zea mays
  misc_feature: Ceres CLONE 1412877-F
  misc_feature (291)..(291): n is a, c, t, g, unknown, or other
  misc_feature (292)..(292): n is a, c, t, g, unknown, or other
tccccgcggtggcggccgctctagaactagtggatcccccgggctgcaggaattcgcacgagaccattacctagaacatcctaatcgaaaacaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaaagctagcggagcctgcgagctagcctgatccgtccgcagtccgatcggaatcatggnngggggaaggcgccgaacccgcggcggctgaccccggcgctgaacatccgggggggggtaccgggggcttgggttcccaaggaaatgctgaacctccgggagggggctcctcaaggaacccgcgcaaccggaagccccccccctttggggggccaccgggggggacccggggaaaaaccctttcccgggaaaaaaaggggggggggccccttttgtattaaaccgttttcccccggaacccgtgtttttttggggggttcccccgggttttaaaggctcttccggggggggaaaagggggaaccccccc

SEQ ID NO: 34352 - DNA, 769 bp, Zea mays
  misc_feature: Ceres CLONE 1412879-F
  misc_feature: Encodes the peptide sequence at SEQ ID NO. 34353
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (612)..(612): n is a, c, t, g, unknown, or other
nnnnnccccccccnnnnnnnnntaaaaaacaaatacaaaccgcgtcttttttcaaactggagctccccgcggtggcggccgctctagtactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgccatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtggggcgagctctgccggtccgtgctctgtccgtctgtccccttcgccgtccaccggatgctctactacggttgccttcgcccgggttcccgtctcccacgccgccgcctggacgcccgacccccaagggaggctgtcttgaccaatggtcggccgtgtcctcgagggcgcgtgggtaagggacttcatcgggcgacgcggtacaaggaatcccatcacccagcttcccagaccctccncaaggttctccaacgagaaaccaagaagcgggacatggaaagatgggtatttgggggggatattgggtattccaatttcagggggaaaggccatccttgcatttgggaagagaagaaccctggcataaccctggggggcgcgaatgggctctacaag

SEQ ID NO: 34353 - protein, 177 aa, Zea mays
  misc_feature: Ceres CLONE 1412879-F
  misc_feature (125)..(125): Xaa is any aa, unknown, or other
MATTLHKPLGAITVDDLAAAAPGSDATALHAALRRALDSHGPTEVWGELCRSVLCPSVPFAVHRMLYYGCLRPGSRLPRRRLDARPPREAVLTNGRPCPRGRVGKGLHRATRYKESHHPASQTLXKVLQRETKKRDMERWVFGGDIGYSNFRGKGHPCIWEEKNPGITLGGANGLYK

SEQ ID NO: 34354 - DNA, 671 bp, Zea mays
  misc_feature: Ceres CLONE 1412882-F
  misc_feature: Encodes the peptide sequence at SEQ ID NO. 34355
  misc_feature (294)..(294): n is a, c, t, g, unknown, or other
  misc_feature (536)..(536): n is a, c, t, g, unknown, or other
cgcggtggcggccgctctagaactagtggatcccccgggctgcaggaattcgcacgagaccattacctagaacatcctaatcgaaaaacaaaagcgagagcaaagcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgacagggaggagcgagggagcgcgcggtagagaaagccggcgcggnccgaggaaggaaggaaggagcgccggccgcagcagacgtcccctcggtgccctcggtcggatgagatcgacgatgaaggggcagcacgtctacgggtgcttgagtacgagccccttcctgacgtcctacgggctcacgctcgtcttcatcaccttcgtctccgtgctctactttaaggacttctcctccacgctgcaccgccccttcctccaccgcccccgccgccacgccgccccagaaanagcccaggcggggcgccgcgcgcctgggggatcgtctgccagttcgcggtggccgcgcaacccgcgggtttgagacgcccggcggaggggagtgggagacccaccacccggggcgtcccggggaccaggaggagg

SEQ ID NO: 34355 - protein, 84 aa, Zea mays
  misc_feature: Ceres CLONE 1412882-F
  misc_feature (61)..(61): Xaa is any aa, unknown, or other
MRSTMKGQHVYGCLSTSPFLTSYGLTLVFITFVSVLYFKDFSSTLHRPFLHRPRRHAAPEXAQAGRRAPGGSSASSRWPRNPRV

SEQ ID NO: 34356 - DNA, 950 bp, Zea mays
  misc_feature: Ceres CLONE 1412882-R
  misc_feature (1)..(1): n is a, c, t, g, unknown, or other
ncgattgggtaccgggccccccctcgaggtcgacggtatcgataagcttttttttttttttttttacgaaggggcgaagccccctatttcattaggaaatagggaagttggcgaacaacgacatccatcgcgatcaaacgatccgaccgaatagcaattagggcagatctctatctagacaccttacactatcaacctagatgagtagagggcctaggatagaagataaagttcgacctgcgactagcggcataagactttcgtattgacaaccagatcacgacagacaggcgagcacaaaaggcacagattcgagtcatcaactattagaaaggctatctgccactgcagaatctacatcccagttatgatcagccagaaattcgcatcatccatacggccggcctgaacgccctcacttggctatcattgcggaattaagctgcttaccttggaacaaccatttttttggccccccggttcccaaaaatccttcctccataatcgtaagaaaggggggagggggggaaacaaaaggggaacccaaaaaaccgggggggaaccaaactccccccccccccgggaaccccggggaaataaaaccccccggaaaacctttctccgggggccttttggttctaagcccctttttccaagggggggaacacacaaatttttccaagggggtttttacgcgggccggttggtggttgaggaaaaaaaaaatccggggggggccccccccccccccacaaatatttttttttttttaagaggggtttgcccacacccctctaaaaaaagtgggaaaaaaaaattttttgggggccccttttttaactcttcaaaaaaaattttttttacacgcggtgtgtgcccccccttcttttgtggcgaccctctttttttttcttgggagagagaaaaaacacccccccggggtgggaggg

SEQ ID NO: 34357 - DNA, 670 bp, Zea mays
  misc_feature: Ceres CLONE 1412889-F
  misc_feature: Translation starting site: 478
aagctggagctccccgcggtggcggccgctctagaactagtggatcccccgggctgcaggaattcgcacgagaccattacctataacatcctaatcgaaaaacgtaacaattttctcgtcttccccttcctcgccgcctccagctaacggcctttgctcttccgaactctcgaaatcctacccatccgatgagagatcgatcggccaagcgcgaattccccatgcgggagcggggggatcggccgccgtccggcgtgctggggcccccgcgccgcgggacgacgaacaagacgaagttgtgcgcgctgtgccagagcggcgactgttcccgcgactcatgcaacttcgcgtacggacacaccgagctccgccgattccccggatcgcgcacctcgttcccatcgccgcggcggcagaacagatcatacagctgaggactttagagataggtttgatgaggaggctgctcacctacatatgaggcattcccctgatggagattccaggggccatcgctcccttcatgaccgacagccaaattcccaagaaagggaatctagctattgccggtctcccagaacgaagagtgaaatgaggcatgtacaaaagcctgatgatggagaaaataactcatctatgagtctcatcgtctctgaccataatgatgata

SEQ ID NO: 34358 - DNA, 650 bp, Zea mays
  misc_feature: Ceres CLONE 1412890-F
  misc_feature: Encodes the peptide sequence at SEQ ID NO. 34359
tcttaactagtggatcccccgggctgcaggaattcgcacgagaccattacctagaacatcctaatcgaaaaaagtagccctccctgttccatcgaacccagcagagcagccagccgaacaacgaagcatgccgtcgaagccgaacgccgcgtcgcgcctcgtcttcctcgctttcctcctcgtcatcagcgccgccgcggccaacgatgacgccgcggcgcggcggacgatggagcagttcgccggcttccccgcctccgacgacggcgagggcccttccagcgacttccacgtcgactccgagggcctccagcgtcagatcgatgaactggcctcgttctccgactcgcccgcgccgtccgtgacccgcgttctgtacaccgacaaggatgtgcaggctcgaaggtatataaaagggataatgaatcaacttggccttgttgttcgagaagaggctgttggtaaaatatttggccgctgggagggttccgagcctggactaggagcagttgcaactggatctcatgttgatgccattccattctcaggaaaatttgattggggtgttggaagtctggctggtcctgaaggaattaggttggtgaaaagggtcggtttcctgccaaaaaattttttgggtggttattagt

SEQ ID NO: 34359 - protein, 173 aa, Zea mays
  misc_feature: Ceres CLONE 1412890-F
  misc_feature: SWISSPROT Homolog: EC 3.5.1.87 N-carbamoyl-L-amino-acid hydrolase
MPSKPNAASRLVFLAFLLVISAAAANDDAAARRTMEQFAGFPASDDGEGPSSDFHVDSEGLQRQIDELASFSDSPAPSVTRVLYTDKDVQARRYIKGIMNQLGLVVREEAVGKIFGRWEGSEPGLGAVATGSHVDAIPFSGKFDWGVGSLAGPEGIRLVKRVGFLPKNFLGGY

SEQ ID NO: 34360 - DNA, 696 bp, Zea mays
  misc_feature: Ceres CLONE 1412896-F
gctctacaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtgacagccgctctcctgctccgtcgtcgccccattgcacagctgccgcacagcatccatggcctacggtgtctctctccagccagagcgacaccttccaggaaggtcctcagcctccccccggccacgttgtcctccttcgcgaacccgaagggaaagggggtttcccggggaaagccaaggaagggggcgcccaggcccggccccgggataaaaaaacaggccgggaaaaggcaaaatgtcggaaaaatcccaaaaatttccccccccccccccggggggggggggcctctcccgggagaatataggttccccccccccccccggggcccttggaaaaaaccccctgggttcgccaccagaacctttggggaaaacaaccgcgggggacaactcccccctccggcggggggttg

SEQ ID NO: 34361 - DNA, 649 bp, Zea mays
  misc_feature: Ceres CLONE 1412898-F
  misc_feature (446)..(446): n is a, c, t, g, unknown, or other
  misc_feature (567)..(567): n is a, c, t, g, unknown, or other
  misc_feature (585)..(585): n is a, c, t, g, unknown, or other
tggcggccgctctagaactagtggatcccccgggctgcaggaattcgcacgagaccattacctagaacatcctaatcaaaaaagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccccgggaaggacgagtgaataatcatgagctcgatctgccctttcgcgggagccacactgggtggntggtgtatgccctgtgaaatctgataagagcaacactggtggtgtgccctgcaaaatctgacaagagcatccagtggtgtatgccctgtcactggcaaggatcatggtagcagctcaaggnaaagtggtggatcatggntgagaaaagggcaccgattcctcgtgtcgtaccagcaaaatgcccattcggctatgactccaca

SEQ ID NO: 34362 - DNA, 761 bp, Zea mays
  misc_feature: Ceres CLONE 1412900-F
  misc_feature: Encodes the peptide sequence at SEQ ID NO. 34363
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (23)..(23): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
tatgcccccccccccnnnnccnncatcccacnnnnnnnnngtaggccacttccaaagctggagctccccgcggtggcggccgctctacaactagtggatcccccgggctgcaggtattcgcacgagaccattacctagaacatcctaatcgaaaaccggcaccttccaaagttccaacttccaagtcacgagaaaggtttcgcttcgaaactcaaccggagatggcgagctctggcggaatctccgaccagctcttcgtctccgttaagttagagagcccgcacctcgcggagctcgacctcgccccccacctcttcggctcccaccctgtggctggctcgtgggacccctgcaaggtcctgcctttggagcgggcggccaccgccgtgtgggagttcagctgcgtcgtgccttcgcagcacgaatcgctggatttcaagtttgttttgaagcgaaaaggtgataatcctcaatacattattgaggagggacctaaccgaccattggggtgccagagaaatgaatttgagatggggaatgcgttgtttaaactcaacgaagggaaggaggtacttgagtgcaaaggttcaggttgagacggaaatgttatccccaattgacttgccgggctaggttggcgaggctcactcaggtagtatttttcaggccttccagggggtggcggggggaactccccggatgtccacttatcaaacccctggggtcttaagaagggtaggggctcaaggacatggggtttt

SEQ ID NO: 34363 - protein, 124 aa, Zea mays
  misc_feature: Ceres CLONE 1412900-F
MASSGGISDQLFVSVKLESPHLAELDLAPHLFGSHPVAGSWDPCKVLPLERAATAVWEFSCVVPSQHESLDFKFVLKRKGDNPQYIIEEGPNRPLGCQRNEFEMGNALFKLNEGKEVLECKGSG

SEQ ID NO: 34364 - DNA, 671 bp, Zea mays
  misc_feature: Ceres CLONE 1412901-F
  misc_feature: Encodes the peptide sequence at SEQ ID NO. 34365
  misc_feature (596)..(596): n is a, c, t, g, unknown, or other
tccccgcggtggcggccgctctagaactagtggatcccccgggctgcaggaattcgcacgagaccattacctagaacatcctaatcgaaaaacgtcgtcccgttgcctcgtgaccgcgcccagggtccgaactcccgaagcgtcgcgccgccgcccatcacggacatcggacaggagaagagaagcgggagcaccggagcaggcaccaccgccgaggcgtcgaggtcgccgtgctccccatccgctgaggtagctgctctccggcctccgcggctgccggctccgccaacgcccagtcccaaggcgagcaggcacccacggcagcacggctgtcgcggtagtatttaaggaacagggaaacatctgctaccgcccaatctttccccttcccggactgctcgctggacgccgaggacgtacgtgtccgccgtctgtttccactcaccgtgtgatactgtgatggtggacttggacgagccgctcgatgcggctgtacctgcggagaagggcaaggcggcgctacaacggttacttgaggctgaccctgcactcttcctctccccctctgcggaacttgctgctgctgcccgagcggnctcgcagcacatctactcctcactggtgccactctaccctggtcaggctcaccggtccctaccctcctcagggac

SEQ ID NO: 34365 - protein, 70 aa, Zea mays
  misc_feature: Ceres CLONE 1412901-F
  misc_feature (46)..(46): Xaa is any aa, unknown, or other
MVDLDEPLDAAVPAEKGKAALQRLLEADPALFLSPSAELAAAARAXSQHIYSSLVPLYPGQAHRSLPSSG

SEQ ID NO: 34366 - DNA, 665 bp, Zea mays
  misc_feature: Ceres CLONE 1412902-F
  misc_feature: Encodes the peptide sequence at SEQ ID NO. 34367
  misc_feature (221)..(221): n is a, c, t, g, unknown, or other
cgcggtggcggccgctctagaactagtggatcccccgggctgcaggaattcgcacgagaccattacctagaacatcctaaaaaaaaaacccaaacccacagccagaaatagggttgcactagctacagctaaacctccccacggaacaggaatggcggcgctccccgtttgcctcctgccctgccgactgatctgcctctgcctcatcggcgcgccggganccacagcagtcgcggcggagcgtgttagccggattctatcggcgtcgcctacccttcggcgctattttccacgtcgtcgtaatcagccgagatggaactcgaagcataaagcgtggcggccggccggcgaggatacgatgcctgtggtgctcggcgcagtcgctagccttcgagccgccgctgtcatcgcctccgaggactcctccttcccctgttccgatcgtctcaagtatcgttttagtagtagtaattttagtagtagtaattgtcattaacctttgcgttccctccgtcgagcacgctcctcggctcggtcctcactttcgcattttcggttttggggctggttgtgctcgatccgaggcttactttggtttttgcgacttctctacttgtgaaaagcttggtgtcggaattcgaccagaagaccggaagaaaaaaaag

SEQ ID NO: 34367 - protein, 114 aa, Zea mays
  misc_feature: Ceres CLONE 1412902-F
  misc_feature (24)..(24): Xaa is any aa, unknown, or other
MAALPVCLLPCRLICLCLIGAPGXTAVAAERVSRILSASPTLRRYFPRRRNQPRWNSKHKAWRPAGEDTMPVVLGAVASLRAAAVIASEDSSFPCSDRLKYRFSSSNFSSSNCH

SEQ ID NO: 34368 - DNA, 708 bp, Zea mays
  misc_feature: Ceres CLONE 1412903-F
  misc_feature: Translation starting site: 170
  misc_feature (174)..(174): n is a, c, t, g, unknown, or other
  misc_feature (307)..(307): n is a, c, t, g, unknown, or other
tccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggncgccgcagacgcgtccgccgagaccgccgccatcgcgcggcgcctggcctccctgcaacaccggcacccgggagcgcgcgctccgctacctcctctctgaatttctgcacggctccgcggcgcggctcttcgncaccgacctcctcaagttctggaagggcatcttcttctgcttctgccacgccgacaagccggttctacaagagttccgtcgccacgggcctcgcctcccgccgtttccggtccggcgtccccccgcgaagggggccgccttcctccgccgctaccttaccaaggttcggcggggggtgggccccaattgcacccccccccgccccggaaaagttctaccccccccacccggggggttcccccaccccgcccctttcggggtttcccgagggaaaaacccttttccccccccccagcccccccccccagaggtgggggccggcgccggggaaaaaaaagagggcctcggcttctccggagaatcggcgaaaatacctcgctcgcgtgtccaccccctccccg

SEQ ID NO: 34369 - DNA, 816 bp, Zea mays
  misc_feature: Ceres CLONE 1412906-F
  misc_feature (12)..(12): n is a, c, t, g, unknown, or other
  misc_feature (14)..(14): n is a, c, t, g, unknown, or other
  misc_feature (16)..(16): n is a, c, t, g, unknown, or other
  misc_feature (20)..(20): n is a, c, t, g, unknown, or other
aaaccctcccantntnttantctatttaatcacgcgagccgtcgtggccaaagttgtagctccccgcggtggcggccgctctataatagtggatcccccgggctgcaggaattcgcacgagaccattacctagaacatcctaatcgaaaacccgggatcctcgttttgtttcccttcccccacccttcctcttcctccctatctatcagcactgctcgccggcgccgcctctgcaaaaggctcacttttgcctccggaacccagcggaatccgccggcggaccggaaacactcgctcgcccccctcaccccctgtctgcccggccgtcggagcgcgtcgcctcctggcgtgcagcagcagtccgtggaaggtggagccgggaggagggaggaggaaggaccgaggacaaggcattaacctggccgagagggggacaggcaaggaggtggggctgcttccgctccgggggctgggagccaaaggctaacggaattggccttggtgccggaaccaggcgaaaaaggagggctttctttttgggggagggccaattcagatgggggtggttccggcgtttgggcaccaaaaccacagcccctccgtttcctccccgaggctcaaggatttgcatggccacacccccgccccgcgagctcccacccacgggggccagagattacaacacgcggcattcccacagtcgcggtgggttgggggatgttcccgcgggcagggcagccgaacaagaggggggcttggtgtggcccgcggcgcgcgacgcacgcgcaccgcgcggcgggggtggcgcggccgtcc

SEQ ID NO: 34370 - DNA, 662 bp, Zea mays
  misc_feature: Ceres CLONE 1412907-F
  misc_feature (478)..(478): n is a, c, t, g, unknown, or other
cgcggtggcggccgctctatcactagtggatcccccgggctgcaggaattcgcacgagaccattacctagaacatcctaatcgaaaagcgaccgcgactcggatcggatctctctcctgtgtagagccatgctgtgctgtgctggtagtagcagcagcagtagcaatgagtagtccagtccacagctccaagaacacgtggccgtcctttccttgcctctccctatcggtattcggtaacgcagggggagggcgccaccggctttaaccatggcctgtcgcttttgcctcgtctggtcggctggtccctctgctctatcccatcccccttgagcaggctgttgagcaagctgaactcatacgaacctcgatttcttccgtccggcgtttttttttctctcagtttctgaggtatttctccccctttctttcttccctccctcccagtagattcttcactggctcggggatttggaacnaaggccgtggttcgaagctggtgtgttcgttcaattgtgcggaaagaaaggccagtgttatgtgtgaagtagtgaaggctaccaggtatgctggctctcgcctcgccgagcgagggatctcgagttcggtaggctcctgaagcccccaaagagagactcgcgcaaaaccacccttgctgctgac

SEQ ID NO: 34371 - DNA, 678 bp, Zea mays
  misc_feature: Ceres CLONE 1412908-F
  misc_feature: Encodes the peptide sequence at SEQ ID NO. 34372
  misc_feature (635)..(635): n is a, c, t, g, unknown, or other
cgcggtggcggccgctctataactagtggatcccccgggctgcaggaattcgcacgagaccattacctaaaatatcatacgaaaaaaggacgactgactgcgtctcgcatctatcctgactcaacaacaacagcagatttaactgtagaaggggcgaagaacaccgacatgctctggcaacgacgttgcaccagtcccctcgatagtgatgagcgatgacgacctcgacgcgcaagcagatgtcactccacgcctgctcgttccgcgcttcgtctcggccggtgctcgaaaggatcatgacacagcgaaatgcgtggctccatctgcggcgtcgtgatctgggcgtcggacaccgtcgccgcgatgtgatggggcaaaaaaacctctacaagttttacttgttctaccaaacacgagctgaacttgcatgtgaatgttaagccgttgcaattgttttgctgaagaaaagatcggagtactgttattaaatcttggtggtccagaaaccctagacgatgttcaaccattcttgatcaacctatttgctgatccagatatcattcgactgcctagggctcttcaggttccttcaaagaccactggccaaacttatttctacttttagagctcctagnagtaaagaaggatatgcttcaatcggtggtgcgccaccattgg

SEQ ID NO: 34372 - protein, 63 aa, Zea mays
  misc_feature: Ceres CLONE 1412908-F
  misc_feature: SWISSPROT Homolog: EC 4.99.1.1 Ferrochelatase
MLSRCNCFAEEKIGVLLLNLGGPETLDDVQPFLINLFADPDIIRLPRALQVPSKTTGQTYFYF

SEQ ID NO: 34373 - DNA, 675 bp, Zea mays
  misc_feature: Ceres CLONE 1412908-R
  misc_feature: SWISSPROT Homolog: EC 1.6.99.5 NADH dehydrogenase (quinone)
caattgggtaccgggccccccctcgaggtcgacggtatcgataagcttttttttttttttttttgcacagaaaggagctccatcagtttgtattatttcggtagaaagaaatcagaaaactagtacatgcggctggcacatcatgcagaagccgccaacagctccctttcagctcgctcgcggatcctcctctccaactccggcctgaagtgcctgataagtccctgcacaggccacgccgcagcgtccccgagggcacagatagtatgcccttcgatttgcttcgtgacctcctgaagcatgtcgatttcctctagcttcgcgtcaccaaccttgagcctctccatgatcatccagagccagggcgtgccctctcggcagggcgtgcagatgaccaagctctcgaggaagattttccacagagttctgcacagactacctgttcagaatctggaaatacgagaagtcgagatggctcgtcacgaagtgctggtattgaacttgatctgaacagagcttatgaagttgcagacaatggccaatttgtaccaaatgcttcacacagagttgaagtcccattgttttcgacgagatcgttacctagagttttatctaatgctggcgcaaatagctcaagggactttgatcttaatagtggacccgacctttatgatg

SEQ ID NO: 34374 - DNA, 675 bp, Zea mays
  misc_feature: Ceres CLONE 1412911-F
  misc_feature: Encodes the peptide sequence at SEQ ID NO. 34375
  misc_feature (662)..(662): n is a, c, t, g, unknown, or other
tccccgcggtggcggccgctctacaactagtggatcccccgggctgcaggaattcgcacgagaccattacctagaacatcctaatcgaaaaaaaaagggtaccggaagcggcgaaagcctcgcctcccgccgctctcgcatcgtctccagagcgcacgtcagatcaggtgcgccgcgcccccctcgcctaagctgcgacgaccatccatcgaacaggaaggatgacgggctccatggatctcccggccaagtgcgggttcagcttcgacctgtgtcgccggaacaacatgctggagaagaacggactcaaggtcccgggattcaggaagaccgggacaaccatcgtcggcctcgtctttcaggatggttgttcttggggcagacacaagggcaactgagggcccgttcatccttccttcccccgtcgaatcccaccttccttcccccgcccgttaagcagccgagtcagcagcaatggcggccgtgctgaggagagccgtggcgcagtgcttcgcgtcgtcgtcgtcgtcgtcgccggcgacgttcggcctccgccggctcctgctgggcccgccgcgttccgccccggcgtgcccgcccgttctttttttgcccctgtgctaccgttccgcctctccggtctccgctcccctccccgctgncggcgcccctccg

SEQ ID NO: 34375 - protein, 58 aa, Zea mays
  misc_feature: Ceres CLONE 1412911-F
  misc_feature: SWISSPROT Homolog: EC 3.4.25.1 Proteasome endopeptidase complex
MTGSMDLPAKCGFSFDLCRRNNMLEKNGLKVPGFRKTGTTIVGLVFQDGCSWGRHKGN

SEQ ID NO: 34376 - DNA, 678 bp, Zea mays
  misc_feature: Ceres CLONE 1412912-F
  misc_feature: Encodes the peptide sequence at SEQ ID NO. 34377
ggagctccccgcggtggcggccgctctataactagtgcgtcccccggactgtaggaattcgcacgagaccattacctataaacatcctaatcgaaaaaccgcactttcgaggatctccgagccccataataccttgaccggaccaagaccgaactagagtacagaggatacaccgcgccctggaggccttaacgcgctctcgtgcgtagagcatgggtatcgtgtgtcggcgcggcggccagagaggaaacggatctaggaggctcacctgagtcgaggagatggaccgcaaagatgtcgtaatcctcgccatggacatctacttcccgccctcctgcgtgcagcaggaggcacttgaggaccatgatgaggcgagcaaagggaagtacaccattgggcttgctcaagattgcatggccttttgcagcgaggtggaggatacatctctatgagtttgacggggggcatcctctgctgaagaactaaagatggatcccaagctacccggtcgcttgaaggtttccttgtatccagttgttgaacaaaaaaaaacatgggaaattgtgggctccatccctgtgtcgtaatttgctcgtcgtgataatcatttgcccttctccctaatggatattgaaggcggggttccctgccctaaagcggagctggaatatcgtgtcg

SEQ ID NO: 34377 - protein, 56 aa, Zea mays
  misc_feature: Ceres CLONE 1412912-F
  misc_feature: SWISSPROT Homolog: EC 2.3.3.10 Hydroxymethylglutaryl-CoA synthase
MDRKDVVILAMDIYFPPSCVQQEALEDHDEASKGKYTIGLAQDCMAFCSEVEDTSL

SEQ ID NO: 34378 - DNA, 741 bp, Zea mays
  misc_feature: Ceres CLONE 1412916-F
  misc_feature: Encodes the peptide sequence at SEQ ID NO. 34379
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (39)..(39): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
nnnnnnnnnnnnnnnnnnnnggggnnnaaaaatggggtntccggtggggggttcttcccnnnnnnnccaaagctggagctccaccgcggtggcggccgctctagaactagtggatcccccgggctgcaggaattcgcacgagaccattacctagaacatcctaatcgaaaaagataatacacctcttcttccctcaccttcctccttctcccagctgcggcgccaccctcgggccgtccgccgtcggcggccacgaccctggtgtaatctgctccactacgtggcggcgcctgcaaaagccacgctgctgccagtgccagccatggatgcagtggcgaccagcgacgccgtactcctccttgccgccgtagctatctccctgctcatcactgcccactttctggagcaggcatcgtcgtcagggcgaagcgccgagcccgccgtcgctaccgctgctgggccacctccacctgctcgggaaacggcaagccgctgcaccactcgctggcggcgctggccatcgcgcgcggcaccgggggcgcccccggcgccgctcctgccgctgcgcctgggcgcggggggcgcgctgctgggggagaaagcaggccgcgggcggaggaagggttccacggggcacgacgccggcgccgggcggccgggccgcgggacggctgggtctgggaaaagggtccaacttagggggggaggcgagggggggggggggtccccccaaagggggaa

SEQ ID NO: 34379 - protein, 139 aa, Zea mays
  misc_feature: Ceres CLONE 1412916-F
MDAVATSDAVLLLAAVAISLLITAHFLEQASSSGRSAEPAVATAAGPPPPARETASRCTTRWRRWPSRAAPGAPPAPLLPLRLGAGGALLGEKAGRGRRKGSTGHDAGAGRPGRGTAGSGKRVQLRGGGEGGGGSPQRG

SEQ ID NO: 34380 - DNA, 761 bp, Zea mays
  misc_feature: Ceres CLONE 1412917-F
  misc_feature (392)..(392): n is a, c, t, g, unknown, or other
  misc_feature (491)..(491): n is a, c, t, g, unknown, or other
  misc_feature (502)..(502): n is a, c, t, g, unknown, or other
  misc_feature (603)..(603): n is a, c, t, g, unknown, or other
  misc_feature (604)..(604): n is a, c, t, g, unknown, or other
  misc_feature (626)..(626): n is a, c, t, g, unknown, or other
  misc_feature (628)..(628): n is a, c, t, g, unknown, or other
tggagctccccgcggtggcggccgctctagaactagtggatcccccgggctgcaggaattcgcacgagaccattacctagaacatcctaatcgaaaacgttcactcctctgcgtccggtcttcttcgtcccctccgtcgccttcacacctgcttgccatttgcgatttcaccgtcccgtcccgtggcgcaacgaccgccgccttccggccacccggtcgcggctcccccggattcgcgcccaccgcgcctccggatcgtctcggagatctgccgctgagggagttgcatataatctgagctggtgctcctcaagtgttcggaagaggtccctgttttattcgtttttgttggtgcgactgcgagtgtaatggaggaagtggaggaggcgaancagggaagccgtggagagctgccacagggtgctcgccttgctctcccagccgcatggatcccgcgcaggccaggagcatagctctgggcacggacgagncattgccaggntccaggggaaggtggtctctctatgagcatggggaggacggggctaggagaaaaaccgggccgtcaggccggaagcggaagcgaaagcgcaagccgtccannagctaagcttgttagcagaacnangaatccccaggttcttggacccagaaagcttctgacgcaaaacaccccgcgggggggggggtgttgaaagcgcccatcctctatataactcccggggaagggtaacctaagaactggagctctatcgaaggga

SEQ ID NO: 34381 - DNA, 652 bp, Zea mays
  misc_feature: Ceres CLONE 1412920-F
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (307)..(307): n is a, c, t, g, unknown, or other
  misc_feature (308)..(308): n is a, c, t, g, unknown, or other
  misc_feature (558)..(558): n is a, c, t, g, unknown, or other
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctgggttgctgcctttgctggtggtagccctcggcgcaggcagccaagacagagagagcgagatgaatgtgaacgacgtgctgctaatggtgctggcggccnnnnnnnnnnnnnccttgtgctggcccacaatggggtttggnnttggggcgtcggtgctcaagaaccgggggtggcaaaggcctccccgcgggcccccgggttggccgggggggggaaacccttttcagggggtcgtggagggagggcctttttgtgagggggggggcgccccccgggaaaaaaagggcccccctttccccgggggggggggggcgccccccccttggggggcccctcgggggggaatccccccaagggggtttgggagaaaaaagccccccttttgtggggnaggccggcgggggaaaccccccccccccccccctttttttggggggggggggagggggggganaaaatttttggggcgcaacaacccgccgtgg

SEQ ID NO: 34382 - DNA, 748 bp, Zea mays
  misc_feature: Ceres CLONE 1412922-F
  misc_feature: Encodes the peptide sequence at SEQ ID NO. 34383
  misc_feature (438)..(438): n is a, c, t, g, unknown, or other
  misc_feature (593)..(593): n is a, c, t, g, unknown, or other
  misc_feature (613)..(613): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaacagcgaaccacccatggccctcgccaccactgccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgctggtcccgtggatcgtccgcggggaggacggcaagccccgcctcagcacctccccgccgccggacgtaatccaggccatcgcgctcgcggaggcggaggccaagaaggccgccaagaaggaaaccctcaagggcnaaattgggcgcagttgccgccgccgccgcggctgcttccaatgccagcgtcaagggcaaggaaaggaagcccgccccgaccgtgccgcccaagttctccaggcagggccaggaggttttacaatgagaatatccagggagcgggagccgcaacgnctcgccaaggtctttgccgncccgcagagtggcatcaagaaggaccagtgaggagtctctttccaagggaaagtgatggnnnnntgtggttnaatctgtacttctcctcaagacaaaagtgacatctcaaaggattctatctacgttaacgggaa

SEQ ID NO: 34383 - protein, 175 aa, Zea mays
  misc_feature: Ceres CLONE 1412922-F
  misc_feature (108)..(108): Xaa is any aa, unknown, or other
  misc_feature (166)..(166): Xaa is any aa, unknown, or other
MALATTAVSLHLFLTRPASVLRVGRGLPCLLLRATSSTSASPDFNITFAEPAPSKKAPSAQPLVPWIVRGEDGKPRLSTSPPPDVIQAIALAEAEAKKAAKKETLKGXIGRSCRRRRGCFQCQRQGQGKEARPDRAAQVLQAGPGGFTMRISREREPQRLAKVFAXPQSGIKKDQ

SEQ ID NO: 34384 - DNA, 768 bp, Zea mays
  misc_feature: Ceres CLONE 1412923-F
  misc_feature: Translation starting site: 191
  misc_feature: SWISSPROT Homolog: EC 4.2.1.11 Phosphopyruvate hydratase
  misc_feature (399)..(399): n is a, c, t, g, unknown, or other
  misc_feature (448)..(448): n is a, c, t, g, unknown, or other
  misc_feature (457)..(457): n is a, c, t, g, unknown, or other
  misc_feature (478)..(478): n is a, c, t, g, unknown, or other
  misc_feature (567)..(567): n is a, c, t, g, unknown, or other
  misc_feature (677)..(677): n is a, c, t, g, unknown, or other
caaagctggagctccccgcggtggcggccgctctagaactagtggatcccccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccactttgtctccggccaaggcggcagctggagcagaggcggtgcgatcgatccgcgcgcggcagatcgtggacagccgcgggaaccccaccgtcgaggtcgacctcgntcgccggggacggacgcctcccccgctccgcggtggcccagcggggcgntccacgggngatctaacgaggcgctggagnctccgcgacggtgacaaggccgtataccggcggggaagggcgtaactccaagctgtgcgcacccatcaaacgaggttatcgcgcctagnctcataagggcgtcgatgtgaggacccaaagcgatggttgatgcagtcatgctaagacattgatggactcaaaaaaaatccggaggttggtggcatgcttattctcgagncctccttgaagtgaattgtagggcaggcgctggggggcaaaggaagttcctctgtataaacatattcaggagctagcaggaatttaaggat

SEQ ID NO: 34385 - DNA, 724 bp, Zea mays
  misc_feature: Ceres CLONE 1412926-F
  misc_feature: Translation starting site: 464
  misc_feature: SWISSPROT Homolog: EC 2.7.1.6 Galactokinase
tggagctccccgcggtggcggccgctctagaactagtggatcccccgggctgcaggaattcgcacgagaccattacctagaacatcctaatcgaaaaatcacgaagagtcatcacgccatacgacacggaggacaccgagccggaggcgaagccggtgcgcagcgcgagagtagcggcgagtcggcgaccatcaagcaactgcatggccgcgttacccgccagcacccccgcccccgcccccgccccctccgaggcggcggagctcgtgccgacgctctcctcgctggagcggtcttaacggcgcgggcgcgcagctcgacgaggcgcgcctccgcttcgcccgcctcggggaccgcttccacgccgtctacggcgcccgccccgcgctcttcgcccgtcccccagggagggtcaatctgatcggggagcacatcgactacgagggctactcggttgttgccgatggccatccgccaggacatgatcgtcgccatccgaagggccaacgcgccccagggtgagggtcgccaacgtcgacgacaagtaccccctctgcgtctaccccgccgaccagaacagggaaattgacgtaaaaatcacaaatggggcactattttcatgtgtgaatacaaggggagtttataatactgtagacaaaaggggatagatctggggcaactgttgcgctttgggactccgttgttgatggcacaggtcctcaag

SEQ ID NO: 34386 - DNA, 745 bp, Zea mays
  misc_feature: Ceres CLONE 1412927-F
  misc_feature: Translation starting site: 168
  misc_feature: SWISSPROT Homolog: EC 4.1.1.19 Arginine decarboxylase
  misc_feature (565)..(565): n is a, c, t, g, unknown, or other
  misc_feature (618)..(618): n is a, c, t, g, unknown, or other
  misc_feature (644)..(644): n is a, c, t, g, unknown, or other
  misc_feature (670)..(670): n is a, c, t, g, unknown, or other
tggagctccccgcggtggcggccgctctagaactagtggatcccccgggctgcaggaattcgcacgagaccattacctagaacatcctaatcgaaaaacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggaacatggttaggttcggccagcaatggaactatgggctcgaggctggctccnagccagaactgctcatcgccatgagctgcctccccgtcaccgaagcgagcccnagccgtacttgatctgcaacgctacnaggacgcggactacatcgcgctcggntttctcggggcgggccatgggcctgaacccatcatcgtgcttcaaaaatgggagaagagcttggcatcgtcctcc

SEQ ID NO: 34387 - DNA, 737 bp, Zea mays
  misc_feature: Ceres CLONE 1412929-F
  misc_feature: Encodes the peptide sequence at SEQ ID NO. 34388
  misc_feature (443)..(443): n is a, c, t, g, unknown, or other
  misc_feature (446)..(446): n is a, c, t, g, unknown, or other
  misc_feature (447)..(447): n is a, c, t, g, unknown, or other
  misc_feature (506)..(506): n is a, c, t, g, unknown, or other
  misc_feature (576)..(576): n is a, c, t, g, unknown, or other
  misc_feature (577)..(577): n is a, c, t, g, unknown, or other
  misc_feature (676)..(676): n is a, c, t, g, unknown, or other
  misc_feature (678)..(678): n is a, c, t, g, unknown, or other
ctggagctccccgcggtggcggccgctctagaactagtggatcccccgggctgcaggaattcgcacgagaccattacctagaacatcctaatcgaaaatcttcaagggcacagccgcgcggccaccaccaacaccacctggccccgtccttcctttcttgtgttgccgctaggccatacacacacgacgtcgctgctccgcatggccaacgccaatggctcgtccaccggtgcaggccatagcgacctcgtcagggccatttcgcacgagcagcaccaggcgttcatggcctccgtgccccgggccgcaccgggcggggtgaatgtgcaccaccagcagcacttccaccaataccccgccggcttgatcccagcgccggtggcactgccggttcacgcacccggtggtgtcgtcacagacgtctccgtactccgccagatcgnggnntgcgccgccgccgccaccactcatcgcatctccagaacaccgcctgcactccctgccgnctaacggatgctaccagctggactattctccatatggcaacgctgctgcgccttcgcagcagcacaatcnncaaataaaggggtttgctgactggggaacgcacagcaatgcgctcatgtccttggctcatgcccactagtttttggaaaacacgggagcagcatatcancnagcatggattattacatcaaaacttatccccgtacaccacgcatacttgacttactact

SEQ ID NO: 34388 - protein, 101 aa, Zea mays
  misc_feature: Ceres CLONE 1412929-F
  misc_feature (81)..(81): Xaa is any aa, unknown, or other
  misc_feature (82)..(82): Xaa is any aa, unknown, or other
MANANGSSTGAGHSDLVRAISHEQHQAFMASVPRAAPGGVNVHHQQHFHQYPAGLIPAPVALPVHAPGGVVTDVSVLRQIXXCAAAATTHRISRTPPALPA

SEQ ID NO: 34389 - DNA, 670 bp, Zea mays
  misc_feature: Ceres CLONE 1412930-F
  misc_feature: Encodes the peptide sequence at SEQ ID NO. 34390
  misc_feature (182)..(182): n is a, c, t, g, unknown, or other
  misc_feature (212)..(212): n is a, c, t, g, unknown, or other
  misc_feature (281)..(281): n is a, c, t, g, unknown, or other
  misc_feature (285)..(285): n is a, c, t, g, unknown, or other
aaagtggagctccccgcggtggcggccgctctagaatagtggatcccccgggctgcaggaattcgcacgagaccattacctagaacatcctaatcgaaaaattttgcttggctgctgctcccttctcccaccgaccaactcgatcccgcgccatggatcgcgccgaccccgcgcggggccgncttgccgtgctctcctcccacctccgtggntgcagggccgaagaagccgcggggctggaaaaggtcgccgtattcgcgccgggggcccgggccccgcgnccgngcgctttggccgggggggaccggaggacccggaaaagggaccaaggtcaaggtctcccaaaaaagggaccgggggcggccccccaatttcaaaaagaataccccctgtgaaagggcgaccaaggggcttaaaaaattaatgaacccggggaaacctaaaaactgggccctgtgtcgcccccccccacttggttaacatgggggggggaagggggggaaaccttctcccttttggggggtttcccccccccaaaaaatgggttgaaaaaaacctccttttttttggggggggccccccccctttaaagggggggggaaaattgccccctccaaaaacaattggggagggggggggaaatttgtgatatttccaaaattttgggggg

SEQ ID NO: 34390 - protein, 80 aa, Zea mays
  misc_feature: Ceres CLONE 1412930-F
  misc_feature (45)..(45): Xaa is any aa, unknown, or other
MDRADPARGRLAVLSSHLRGCRAEEAAGLEKVAVFAPGARAPRPXALAGGDRRTRKRDQGQGLPKKGPGAAPQFQKEYPL

SEQ ID NO: 34391 - DNA, 732 bp, Zea mays
  misc_feature: Ceres CLONE 1412932-F
  misc_feature: Encodes the peptide sequence at SEQ ID NO. 34392
  misc_feature (449)..(449): n is a, c, t, g, unknown, or other
  misc_feature (457)..(457): n is a, c, t, g, unknown, or other
  misc_feature (470)..(470): n is a, c, t, g, unknown, or other
  misc_feature (471)..(471): n is a, c, t, g, unknown, or other
  misc_feature (535)..(535): n is a, c, t, g, unknown, or other
  misc_feature (556)..(556): n is a, c, t, g, unknown, or other
tggagctccccgcggtggcggccgctctagaactagtggatcccccgggctgcaggaattcgcacgagaccattacctagaacatcctaataaaactgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggttcagccaaagctattttctaagaaaaatggcggcaatgatggtggcgatgactgcgaggagcaagaacagcatattacccgtggagaagaagcagggctggtctattcagctaccagagctccggttcccttgggattcacatggaagacaagggtttctctctgagtctgcaaggatctggaccttctcatggncggctggnttgctagcgtggnntcttaaagggtcgacaggggccccagcagtggcgccccgggaccgggtgacaaggaatattaangatccattcactgatcattgnaatgaagtacgggcctgaaggcaggtggggtaacaggttattaacactgaagcgagcccgggggggggggggggggggggaatggtaaagggaaagaagcaggcaaagaaacgggggctgcagctgaaaaataaagattggaacccccatttggagggggctggttagggacccct

SEQ ID NO: 34392 - protein, 97 aa, Zea mays
  misc_feature: Ceres CLONE 1412932-F
  misc_feature (57)..(57): Xaa is any aa, unknown, or other
  misc_feature (64)..(64): Xaa is any aa, unknown, or other
  misc_feature (85)..(85): Xaa is any aa, unknown, or other
  misc_feature (92)..(92): Xaa is any aa, unknown, or other
MAAMMVAMTARSKNSILPVEKKQGWSIQLPELRFPWDSHGRQGFLSESARIWTFSWXAGLLAWXLKGSTGAPAVAPRDRVTRNIXDPFTDHXNEVRA

SEQ ID NO: 34393 - DNA, 755 bp, Zea mays
  misc_feature: Ceres CLONE 1412933-F
  misc_feature: Encodes the peptide sequence at SEQ ID NO. 34394
  misc_feature (312)..(312): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacnagctccgccaggttgctgtgtgaagtccaaggttgtcacatggattcagcacaagatttccaacccaggacattctctataaagttgtggccaccaagtgaaagcacacggatcatgcttgttgacaggatgacaaacaatctgtctacagagtccattttctctcgcaaatatcgcccttttggaaagcaagaggctcatgagaatgcaaaaacgattgaagaactttgctttgccttgnctgatgagcatttcagagaggagcagatgggtgatgggagttctgctgtccagctatatgcaaaggaacgagcaaatggatggttggagttctgaaaaaaggcccaggactactgcagaactggaggcacctgtagctgacacacctcttgggctgctgaactgactaaatatatctggggggcagcgtgcttttattgagg

SEQ ID NO: 34394 - protein, 98 aa, Zea mays
  misc_feature: Ceres CLONE 1412933-F
  misc_feature (68)..(68): Xaa is any aa, unknown, or other
MDSAQDFQPRTFSIKLWPPSESTRIMLVDRMTNNLSTESIFSRKYRPFGKQEAHENAKTIEELCFALXDEHFREEQMGDGSSAVQLYAKERANGWLEF

SEQ ID NO: 34395 - DNA, 666 bp, Zea mays
  misc_feature: Ceres CLONE 1412935-F
  misc_feature (372)..(372): n is a, c, t, g, unknown, or other
aaagctggagctccccgcggtggcggccgctctagaactagtggatcccccgggctgcaggaattcgcacgagaccattacctagaacatcctaatcgaaaagatttcgcaagctcctggttacggcggcatctatcgttccgccgcatcgtctctctcgcgacgctgccccagaccgccgagataatggctggccaccgaaacagtcatggaaagcgccagtctgattttactgaaaatggaggcggtaagagaagaaatcctgggcgatgatacatatgcacctggtcctgatgacactgtgtatcgctacctctgtctctagaaaattggggagtatcattggcaggggtggagaaattgcaaagcagntgaggactgagacccagctaagatcaggattggcgagagtgtccctggatgtgatgaccgggtaataccatttttaccccaagcgggaaactaaaccctccagggggttaaaaataaggtttgccccgccccgagtgcccttttaaaattcaggaaaggtttgcccggaataggggttttggaacaaaaaaccggaaaaatttcccccccaattttggttccctttgttggggccccaaacccaatggggtgttttttttggaagagggggggaaaattccccgggaacccccc

SEQ ID NO: 34396 - DNA, 645 bp, Zea mays
  misc_feature: Ceres CLONE 1412936-F
  misc_feature: Encodes the peptide sequence at SEQ ID NO. 34397
  misc_feature (137)..(137): n is a, c, t, g, unknown, or other
  misc_feature (167)..(167): n is a, c, t, g, unknown, or other
  misc_feature (169)..(169): n is a, c, t, g, unknown, or other
  misc_feature (170)..(170): n is a, c, t, g, unknown, or other
  misc_feature (172)..(172): n is a, c, t, g, unknown, or other
  misc_feature (174)..(174): n is a, c, t, g, unknown, or other
  misc_feature (176)..(176): n is a, c, t, g, unknown, or other
  misc_feature (178)..(178): n is a, c, t, g, unknown, or other
  misc_feature (180)..(180): n is a, c, t, g, unknown, or other
  misc_feature (182)..(182): n is a, c, t, g, unknown, or other
  misc_feature (184)..(184): n is a, c, t, g, unknown, or other
  misc_feature (185)..(185): n is a, c, t, g, unknown, or other
  misc_feature (188)..(188): n is a, c, t, g, unknown, or other
  misc_feature (190)..(190): n is a, c, t, g, unknown, or other
  misc_feature (192)..(192): n is a, c, t, g, unknown, or other
  misc_feature (194)..(194): n is a, c, t, g, unknown, or other
  misc_feature (195)..(195): n is a, c, t, g, unknown, or other
  misc_feature (480)..(480): n is a, c, t, g, unknown, or other
  misc_feature (507)..(507): n is a, c, t, g, unknown, or other
  misc_feature (559)..(559): n is a, c, t, g, unknown, or other
  misc_feature (595)..(595): n is a, c, t, g, unknown, or other
aagctggagctccccgcggtggcggccgctctagaactagtggatcccccgggctgcaggaattcgcacgagaccattacctagaacatcctaatcgaaaaagcctgcgctccccttctttcccgttcggctcacangcgaagaaggaagccggttagggtttcccnanncncntncncntntnntcncncncnntcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcacagctcttatgaactcgacaagctccaagatacagcagcttcaggaggcatttgctgagcttgagagccagagcacggtttccatgaacctcaagtggaagcagcttgaagaccactttcgtggtcttggacagtccctcangaaaaagtttgacgagctaaagagcanggagaaggagtccaggagactgtcgcaaatcagagcaaatctggagcagcgnaaggcagctgttgtggcaaggactgacttctttggnaaattgcagaaaaagaggagctgcttaactatgacctttacaggcccggt

SEQ ID NO: 34397 - protein, 109 aa, Zea mays
  misc_feature: Ceres CLONE 1412936-F
  misc_feature (55)..(55): Xaa is any aa, unknown, or other
  misc_feature (64)..(64): Xaa is any aa, unknown, or other
MSDMESVTALMNSTSSKIQQLQEAFAELESQSTVSMNLKWKQLEDHFRGLGQSLXKKFDELKSXEKESRRLSQIRANLEQRKAAVVARTDFFGKLQKKRSCLTMTFTGP

SEQ ID NO: 34398 - DNA, 757 bp, Zea mays
  misc_feature: Ceres CLONE 1412942-F
  misc_feature: Encodes the peptide sequence at SEQ ID NO. 34399
  misc_feature (486)..(486): n is a, c, t, g, unknown, or other
  misc_feature (487)..(487): n is a, c, t, g, unknown, or other
  misc_feature (492)..(492): n is a, c, t, g, unknown, or other
  misc_feature (610)..(610): n is a, c, t, g, unknown, or other
  misc_feature (622)..(622): n is a, c, t, g, unknown, or other
  misc_feature (654)..(654): n is a, c, t, g, unknown, or other
  misc_feature (695)..(695): n is a, c, t, g, unknown, or other
  misc_feature (716)..(716): n is a, c, t, g, unknown, or other
  misc_feature (722)..(722): n is a, c, t, g, unknown, or other
aaagctggagctccccgcggtggcggccgctctagaactagtggatcccccgggctgcaggaattcgcacgagaccattacctagaacatcctaatcgaaaaatctccctgtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgctaggttcctcaaggcgggcaagtacgctgagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactggttgggtggtgccaccatcgcgnnagcgnaggtgttatgcctaacatccatcagcatctgctccccaagaaggctgcctcctccaaggccagtggtcgacgacgacgaccactgagactgcttcctgcagaaatgatcgaccaccgngcttgttttgangaataaggggatgatgtttgtctcgattcggnagaaggagtcggtattggctgggaaggagaataaaattagnatctgttttttttgatggggnatgggnaaacgtggctggggaaatctcagggattgtatgct

SEQ ID NO: 34399 - protein, 152 aa, Zea mays
  misc_feature: Ceres CLONE 1412942-F
  misc_feature (19)..(92): Pfam Name: Histone Pfam Description: Core histone H2A/H2B/H3/H4
  misc_feature (106)..(106): Xaa is any aa, unknown, or other
  misc_feature (108)..(108): Xaa is any aa, unknown, or other
  misc_feature (151)..(151): Xaa is any aa, unknown, or other
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLVGWCHHRXSXGVMPNIHQHLLPKKAASSKASGRRRRPLRLLPAEMIDHRACFXE

SEQ ID NO: 34400 - DNA, 656 bp, Zea mays
  misc_feature: Ceres CLONE 1412950-F
  misc_feature: Encodes the peptide sequence at SEQ ID NO. 34401
aagctggagctccccgcggtggcggccgctctagaactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaataaaagcggcggcgtcggaggaggaggatgctggcggcatgctactcatcgagacctgctgccggcgccgctcaaggccagtgtcagtgcggctcctctagccccggtggcggaggtgcaagcggcagcctcgtgggaagaacaccgcgcgcgttctcgagctgctccagctacgccgcctcgactgcctgcgcgccggaggcgtgcgtccatctcgtgacccagcacaagctgacggcgctcctcgtcgcgttcgcgctcctcctcgtcctccctcgccctcctctcgtggaaggggtcaccggtggtgtctccccgcacgatggcgaggatccgcagccacgtggagaggatcaacaagacctcccgtgcgctccattgatagccaggacggcgacactatctactgcgtggcgacgcacgagcagcactgtctgaac

SEQ ID NO: 34401 - protein, 136 aa, Zea mays
  misc_feature: Ceres CLONE 1412950-F
MLAACYSSRPAAGAAQGQCQCGSSSPGGGGASGSLVGRTPRAFSSCSSYAASTACAPEACVHLVTQHKLTALLVAFALLLVLPRPPLVEGVTGGVSPHDGEDPQPRGEDQQDLPCAPLIARTATLSTAWRRTSSTV

SEQ ID NO: 34402 - DNA, 654 bp, Zea mays
  misc_feature: Ceres CLONE 1412952-F
  misc_feature: Encodes the peptide sequence at SEQ ID NO. 34403
  misc_feature (617)..(617): n is a, c, t, g, unknown, or other
ggagctccccgcggtggcggccgctctagaactagtggatcccccgggctgcaggaattcgcacgagaccattacctagaacatcctaatcgaaaagggtctccgtgtggtctctgcgaatccacttgctcttttcgctggccctgagtacttgcggcaactcccatctgcacgcgttctcccgtccgagatctccaccgcctcgccgaactagcgactgacgggtgaacggacccgccggtgatgcggaactgatgctccgaggaggtgagtcacgacggtgctcatcccgtgggatccgccaccgccgaagccgcctccgcagtctccggcgcgggcgatcgctttctccggtcccgtggtgacggagcggccacgcagagggagttatctctcgctgcatcatgttagggagatcaagaatatcttcccaagagtaatcccatggcgcttgtgaattccagaaagagagatggcacactagaagaaattgggcgaaatgatgaaattttaaattcatggaacgcattttggacgatcaatatcagtgtgcagaacacagtttgagggtcttcaacaatttggtgccttcaggtctgtgacatgcacccagcagnatccggagatgcaaagcgaaaatatgtttagggctat

SEQ ID NO: 34403 - protein, 40 aa, Zea mays
  misc_feature: Ceres CLONE 1412952-F
MALVNSRKRDGTLEEIGRNDEILNSWNAFWTINISVQNTV

SEQ ID NO: 34404 - DNA, 761 bp, Zea mays
  misc_feature: Ceres CLONE 1412956-F
  misc_feature: Encodes the peptide sequence at SEQ ID NO. 34405
  misc_feature (221)..(221): n is a, c, t, g, unknown, or other
  misc_feature (305)..(305): n is a, c, t, g, unknown, or other
  misc_feature (422)..(422): n is a, c, t, g, unknown, or other
  misc_feature (440)..(440): n is a, c, t, g, unknown, or other
  misc_feature (491)..(491): n is a, c, t, g, unknown, or other
  misc_feature (511)..(511): n is a, c, t, g, unknown, or other
  misc_feature (532)..(532): n is a, c, t, g, unknown, or other
  misc_feature (573)..(573): n is a, c, t, g, unknown, or other
  misc_feature (610)..(610): n is a, c, t, g, unknown, or other
  misc_feature (621)..(621): n is a, c, t, g, unknown, or other
  misc_feature (656)..(656): n is a, c, t, g, unknown, or other
  misc_feature (707)..(707): n is a, c, t, g, unknown, or other
  misc_feature (717)..(717): n is a, c, t, g, unknown, or other
  misc_feature (742)..(742): n is a, c, t, g, unknown, or other
caaagctggagctccccgcggtggcggccgctctagaactagtggatcccccgggctgcaggaattcgcacgagaccattacctagaacatcctaatcgaaaagtacgcaaagccccataccccaataccggtgccgccttcgcctcgcactacacctctccctccctccgcctccatctccttcgccaccagaacccaagcgctgccccacacgccgccncagcccgcacgggagccgcgcgccgcaccaaaaccctaggtctcctccgtcccccgatccatcgccttcatggccgcgccgcancctgtcgcccaggcccccgaggcaccgccgtctgcgcaagtggtgggcaacgcgttcgtgcagcagtactacctcgtgctgcaccagtcaccggatctggtgtaccgcttctatcangaggctagtcgcctcggncgccccgcatccgccgccggagcccgcggcatggactccgtcaccactatngaggcaatcggcgagagatnatggagatggacgtgtcaaangcggagatcaggacggtggactcgcaggagtcgcttggggncgcgcgtcactgtgctcgtcacaggccccctcacggnccgtgacggantggcgcgcgaagttctcgcagtccttcttcctggncgccgcaggagaagggctacttcgtgctcaacgactggttccggctttcgncgggaaatcntgccccctaccgctgtagagcccancccgaggcggatggctttt

SEQ ID NO: 34405 - protein, 157 aa, Zea mays
  misc_feature: Ceres CLONE 1412956-F
  misc_feature (5)..(5): Xaa is any aa, unknown, or other
  misc_feature (44)..(44): Xaa is any aa, unknown, or other
  misc_feature (67)..(67): Xaa is any aa, unknown, or other
  misc_feature (74)..(74): Xaa is any aa, unknown, or other
  misc_feature (81)..(81): Xaa is any aa, unknown, or other
  misc_feature (95)..(95): Xaa is any aa, unknown, or other
  misc_feature (107)..(107): Xaa is any aa, unknown, or other
  misc_feature (111)..(111): Xaa is any aa, unknown, or other
  misc_feature (143)..(143): Xaa is any aa, unknown, or other
  misc_feature (151)..(151): Xaa is any aa, unknown, or other
MAAPXPVAQAPEAPPSAQVVGNAFVQQYYLVLHQSPDLVYRFYXEASRLGRPASAAGARGMDSVTTXEAIGERXWRWTCQXRRSGRWTRRSRLGXRVTVLVTGPLTXRDGXAREVLAVLLPGRRRRRATSCSTTGSGFRREIXPPTAVEPXPRRMAF

SEQ ID NO: 34406 - DNA, 733 bp, Zea mays
  misc_feature: Ceres CLONE 1412958-F
  misc_feature: Encodes the peptide sequence at SEQ ID NO. 34407
  misc_feature (733)..(733): n is a, c, t, g, unknown, or other
caaagctggagctccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtggtcgtcgtcgtcgttggacgtacgccagaagagggagctagagaagaataccgtacagctgcttccaacatggcagctgcctcgtctgcccacctgttcggactcggcgacgggcagatgcagatgcagccgcagcagcagcaggcgccgcctcctcctcttgtgaacacccgggccgcgcgccgcccaagaagaagcggaccaacccggtaacccaaccctgacgcggaggtgatcgcgctttcccccagacgctgatggcgacgaaaccggtcgtgtgcgaggtgtgcaacaagggttccagcgggagcagacctgcagctgcaacgcgcggggacaactggcgtgaagn

SEQ ID NO: 34407 - protein, 31 aa, Zea mays
  misc_feature: Ceres CLONE 1412958-F
MATKPVVCEVCNKGSSGSRPAAATRGDNWRE

SEQ ID NO: 34408 - DNA, 777 bp, Zea mays
  misc_feature: Ceres CLONE 1412963-F
  misc_feature (21)..(21): n is a, c, t, g, unknown, or other
  misc_feature (22)..(22): n is a, c, t, g, unknown, or other
tgtgttccccccccccccctnnataatttgattatctttttccgcacaacaataaaagctggagctccaccgcggtggcggccgctctagaactagtggatcccccgggctgcaggaattcgcacgagaccattacctagaacatcctaatcgaaaagagtgctagtcttcacggcggggttgttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccgggcggggggtgcaggcgcaggcgccgcgccccgcggtgaccatcggggacttcgcgctcgacctcgccggcgtcgcccgacgcggtgccccttccgacgggcccggggctctccggggtaccccgtggtttcccccaagaagacgcctccacgtggcccccccggcgatggcccccgtcccctccctcgctcgcagatagtgcccgcccccccctcccccgccatccccccccacccgccccgccccgagcgcaaatatctcgagccggcacatcgccaccaacccaccacggccacacaactatcggagccgccgcgcgtcctcactgacccactggcgcgccccgccggcggccgccccgccgcccgcccccctcaccgcccc

SEQ ID NO: 34409 - DNA, 721 bp, Zea mays
  misc_feature: Ceres CLONE 1412966-F
  misc_feature: Encodes the peptide sequence at SEQ ID NO. 34410
  misc_feature (344)..(344): n is a, c, t, g, unknown, or other
  misc_feature (469)..(469): n is a, c, t, g, unknown, or other
  misc_feature (560)..(560): n is a, c, t, g, unknown, or other
  misc_feature (565)..(565): n is a, c, t, g, unknown, or other
ggagctccccgcggtggcggccgctctagaactagtggatcccccgggctgcaggaattcgcacgagaccattacctagaacatcctaatcgaaaaatctccctgtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgctaggttcctcaaggcgggcaagtacgctgagcgcgtcggcgccggcgcccccgtgtacctcgccgccgtcctcgagtacctcngcggctgaggttctcgaacttgccgggaacgccgcgagggacaacaagaagacccgcattgtgccgcgccacatcccagcttgctgtgcgcaacgacgaggagctgaccaaactggttgggtggntgccacatcgcggagcgggaggtgttatgcctaacatccatcagcatctgctcccccagaagggctgctctccaagccagtgtcgacgacnacacnactgagactgcttctgcagaatgatcgacaccgccttgtttgtagaataaggatgatgttgctcatcggggaaggatcggtatgctggaagagataaaataaatctgtttttggagggagggggaggggtggaaatccaggattgtgtcgtggaaa

SEQ ID NO: 34410 - protein, 62 aa, Zea mays
  misc_feature: Ceres CLONE 1412966-F
  misc_feature (61)..(61): Xaa is any aa, unknown, or other
MAGRGKAIGAGAAKKATSRSSKAGLQFPVGRIARFLKAGKYAERVGAGAPVYLAAVLEYLXG

SEQ ID NO: 34411 - DNA, 708 bp, Zea mays
  misc_feature: Ceres CLONE 1412968-F
  misc_feature: Translation starting site: 163
  misc_feature: SWISSPROT Homolog: EC 1.11.1.6 Catalase
  misc_feature (340)..(340): n is a, c, t, g, unknown, or other
  misc_feature (341)..(341): n is a, c, t, g, unknown, or other
  misc_feature (366)..(366): n is a, c, t, g, unknown, or other
  misc_feature (367)..(367): n is a, c, t, g, unknown, or other
  misc_feature (405)..(405): n is a, c, t, g, unknown, or other
  misc_feature (440)..(440): n is a, c, t, g, unknown, or other
  misc_feature (448)..(448): n is a, c, t, g, unknown, or other
  misc_feature (454)..(454): n is a, c, t, g, unknown, or other
  misc_feature (493)..(493): n is a, c, t, g, unknown, or other
tccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcnncggagcgcgtggtgcacgcgcgcgnngcctccgccaagggctttcttcgagtgcacccacgacngtgacgtcgctgacgtgcgccgacttcctgcgcgncgcccggngtgcgnacgccccgtgatcgtgcgcttcctcgacgtgatccaccngagcggggttcccccggagacgatccgcgaccccgcgcggggttttccccgtgaaaggtctaccacccgcgaggggcaactggggaacctgcttggggaaacaaactttccccgtctttcttcaatcggcgaagggaatcaagttttcccccggacgtgggatccacggcggttcaagccccaaaacccggggggtcgaaccggtgccagggaac

SEQ ID NO: 34412 - DNA, 636 bp, Zea mays
  misc_feature: Ceres CLONE 1412969-F
  misc_feature (267)..(267): n is a, c, t, g, unknown, or other
  misc_feature (270)..(270): n is a, c, t, g, unknown, or other
  misc_feature (287)..(287): n is a, c, t, g, unknown, or other
  misc_feature (290)..(290): n is a, c, t, g, unknown, or other
  misc_feature (313)..(313): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcgncgncgctggctgccatgtgntgncgtcggtgctccaagaccggcgntgtcgacggcctccccgccggggcctccgggttggcccggtggtggggaacctggttcaagtgatcctgcagcgacgggcctttcatggacgggggggccccaaccctccgggaaaaaaaaacggggccccctcttttcccccagggggggggggggggggaggggccccccccccctcctgggggggcccccccccccgggggggatcattccacccccccccaagagggtggttgtgggaagaaaaaaaacccccccccccccctttttttttttgtagagggcccccccccccaaaaaaaaaaacccccccccccccccc

SEQ ID NO: 34413 - DNA, 717 bp, Zea mays
  misc_feature: Ceres CLONE 1412970-F
  misc_feature: Encodes the peptide sequence at SEQ ID NO. 34414
  misc_feature (368)..(368): n is a, c, t, g, unknown, or other
  misc_feature (378)..(378): n is a, c, t, g, unknown, or other
  misc_feature (392)..(392): n is a, c, t, g, unknown, or other
  misc_feature (397)..(397): n is a, c, t, g, unknown, or other
  misc_feature (404)..(404): n is a, c, t, g, unknown, or other
  misc_feature (461)..(461): n is a, c, t, g, unknown, or other
  misc_feature (583)..(583): n is a, c, t, g, unknown, or other
  misc_feature (680)..(680): n is a, c, t, g, unknown, or other
  misc_feature (694)..(694): n is a, c, t, g, unknown, or other
aaagctggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcgncggtggtggnggagcgcgtggcgntgaanctcaggnggtacttcgacctcgccaaagaggagatcgacaaggccgtgcgcgctgaggagtggnggctccccgacgaggccaccgcgcactaccgcaacgcgatgcgggtcatgctcgaggccaaggccgcgcgcgtccccgatgccgtctcctccagcgagagggggcaggtcagggtgtaccangagaagatcgccaagtggcaggcccaggtcgaggagcggctcaaagtgcttggtcagagaaagcggtgagggggcactggctgcagaagtgcccaangaaggtgctgcaancatcctatcattagactgcaaaa

SEQ ID NO: 34414 - protein, 129 aa, Zea mays
  misc_feature: Ceres CLONE 1412970-F
  misc_feature (49)..(124): Pfam Name: MIT Pfam Description: MIT (microtubule interacting and transport) domain
  misc_feature (36)..(36): Xaa is any aa, unknown, or other
  misc_feature (39)..(39): Xaa is any aa, unknown, or other
  misc_feature (44)..(44): Xaa is any aa, unknown, or other
  misc_feature (45)..(45): Xaa is any aa, unknown, or other
  misc_feature (48)..(48): Xaa is any aa, unknown, or other
  misc_feature (67)..(67): Xaa is any aa, unknown, or other
  misc_feature (107)..(107): Xaa is any aa, unknown, or other
MSFLRSLADSFSSLLFSSGGGAVSMDAAGAAPSPAXVVXERVAXXLRXYFDLAKEEIDKAVRAEEWXLPDEATAHYRNAMRVMLEAKAARVPDAVSSSERGQVRVYXEKIAKWQAQVEERLKVLGQRKR

SEQ ID NO: 34415 - DNA, 763 bp, Zea mays
  misc_feature: Ceres CLONE 1412975-F
  misc_feature: Encodes the peptide sequence at SEQ ID NO. 34416
  misc_feature (364)..(364): n is a, c, t, g, unknown, or other
  misc_feature (389)..(389): n is a, c, t, g, unknown, or other
  misc_feature (390)..(390): n is a, c, t, g, unknown, or other
  misc_feature (602)..(602): n is a, c, t, g, unknown, or other
  misc_feature (622)..(622): n is a, c, t, g, unknown, or other
ctggagctccccgcggtggcggccgctctagaactagtggatcccccgggctgcaggaattcgcacgagaccattacctagaacatcctaatcgaaaataccttcaataagaatggctccatgatatttctggatttgtcatttaatcagcttgactcagagatcccaaaggagcttgggaacatgtactacctcatgatcctgaatcttggccacaacttgctgtctggcgtcatcccaccagaactagctggtgccaagaagcttgctgtactcgacctgtcacacaaccagttggaagggcctattcccaacttctttctcgacgttgtcccttgtcggagatcaacctttcaaataatcnagttgaatggttcattcccagagtnncggttcgctgttcacatttcccgaagatttcatatgagaataacttctggtctttgtggcttcccactgttgccatgcgggcacatggctggctcagtttcttccgatggccaccgatcccaccggaaccagttcacttccccggggtagtgttgctattgggatcttgggtcctcgctgtccgtgtaaaattgggattgtcacttcaaaanttgttgagtgcaaaaagcgnaaagagatccatggaaagagcaggtacctctcgtgaatatacttttgataggcggtctcattctgggactatgaatttccaatgggagactctctggtactaccggcctcagcgtcaccttggtgggatttgagaacgact

SEQ ID NO: 34416 - protein, 139 aa, Zea mays
  misc_feature: Ceres CLONE 1412975-F
  misc_feature: SWISSPROT Homolog: EC 2.7.11.1 Non-specific serine/threonine protein kinase
  misc_feature (82)..(82): Xaa is any aa, unknown, or other
  misc_feature (90)..(90): Xaa is any aa, unknown, or other
MIFLDLSFNQLDSEIPKELGNMYYLMILNLGHNLLSGVIPPELAGAKKLAVLDLSHNQLEGPIPNFFLDVVPCRRSTFQIIXLNGSFPEXRFAVHISRRFHMRITSGLCGFPLLPCGHMAGSVSSDGHRSHRNQFTSPG

SEQ ID NO: 34417 - DNA, 676 bp, Zea mays
  misc_feature: Ceres CLONE 1412977-F
  misc_feature (294)..(294): n is a, c, t, g, unknown, or other
  misc_feature (351)..(351): n is a, c, t, g, unknown, or other
  misc_feature (352)..(352): n is a, c, t, g, unknown, or other
  misc_feature (356)..(356): n is a, c, t, g, unknown, or other
  misc_feature (357)..(357): n is a, c, t, g, unknown, or other
  misc_feature (360)..(360): n is a, c, t, g, unknown, or other
  misc_feature (384)..(384): n is a, c, t, g, unknown, or other
tccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcatcccctctagaagtagaaacattgcttaattggcttggctattgctgttagctccacacaaaagagagaaccggcgncgagctaggagctagccatggacgaacacggcgcggtctcaccgtggagcgtgctanngcgnncgncggctgtgctgctcctgtgtttgncgtcccaggtggctggagggggccctggtggcccccccggggcgtgaacgtgcggtgagggcgcaaggccctgaggggcaccccgggaccgcctcctctggggggacctcatcgagggggaaggtgcctccgggggggggccttgggaaaggccccgtccccgggggatgggcaaaccgattccgcccctcggggtgggggctttcctttcccgggtcctccaagaagaagggggggtcctgtttaaagtgggtgggcccccccccccgacacttaatccccgatcccgggt

SEQ ID NO: 34418 - DNA, 804 bp, Zea mays
  misc_feature: Ceres CLONE 1412980-F
  misc_feature: Encodes the peptide sequence at SEQ ID NO. 34419
  misc_feature (804)..(804): n is a, c, t, g, unknown, or other
tggttttcgtattttgttggaataaaacgaacagagaacccccaccccaaaagctggagctccaccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcggcggtggtgggggagcgcgtggcggtgaaactcagggggtacttcgacctcgccaaagagaagatcgacaaggccgtgcgcgctagaaggaagggggggctccccggacgaggccaccgcgcactaccgaaaggcgatgaagggtcttgctccgaggaaagggccgggcgcggttccccggaggccgtctcctcccaggagaaaggggggccgggattcaatcctggaaccacgcggcaataccaccccccaggaggaaaaaacctaactatcaaacaggccaaagctccatacggaggcgggtcgaggagggaaaacaataacacaccatgacaaaagagcgaaggacgtatatgagcaagcaccaaaatgaatagacataaaaan

SEQ ID NO: 34419 - protein, 145 aa, Zea mays
  misc_feature: Ceres CLONE 1412980-F
MSFLRSLADSFSSLLFSSGGGAVSMDAAGAAPSPAAVVGERVAVKLRGYFDLAKEKIDKAVRARRKGGLPGRGHRALPKGDEGSCSEERAGRGSPEAVSSQEKGGPGFNPGTTRQYHPPGGKNLTIKQAKAPYGGGSRRENNNTP

SEQ ID NO: 34420 - DNA, 670 bp, Zea mays
  misc_feature: Ceres CLONE 1412983-F
  misc_feature: Encodes the peptide sequence at SEQ ID NO. 34421
ggagctccccgcggtggcggccgctctagaactagtggatcccccgggctgcaggaattcgcacgagaccattacctagaacatcctaatcgaaaaagggagggggcgtcgattacactactcactccatccgccatgatgccgagcctctcgaccgccgccgacgatatgtgctggtccgcgtccccccaaccgcgggagcctagcaggagaggaggagccatgtctagattataaagcagctgctggcgtgccttgcaaatcacatcgagcgatgggaatacccagctgattactcgttgtaaatccgccaagcccaggcggctgggtagtccaccgtagacagcggcagctgccccaacaagaagctgctcgagtgcgacctctgccgggacgtcctgctcttcacgctcagcggcaacgatgtatacatgaacacggacgtcttgtggagctacatctcgctctggattatgccacgacaattaaggccgttgaccgggccatgcgacctatgcaaggacaggttgatgcagctctgcccgaccagccggagttcgtaatcaacacgcaaagctcaatctgctgaactacatgaccattgcccctcccaagcaggcctcttcgtagctgagataagctggcatagaagcggtagcgactcttggag

SEQ ID NO: 34421 - protein, 43 aa, Zea mays
  misc_feature: Ceres CLONE 1412983-F
MNTDVLWSYISLWIMPRQLRPLTGPCDLCKDRLMQLCPTSRSS

SEQ ID NO: 34422 - DNA, 508 bp, Zea mays
  misc_feature: Ceres CLONE 1412984-F
  misc_feature: Encodes the peptide sequence at SEQ ID NO. 34423
ggagctccccgcggtggcggccgctctagaactagtggatcccccgggctgcaggaattcgcacgagaccattacctagatcatcctaatcgaaaaaaaaaaaaccgtaatagcaaaaacgactccacacggtccacggcgtcttctccggcgaaccttcgcgagccctcggctcccctctaccaccgctgccgcgaccccgcctccagagcatcctcgggtagcgctctgggcttcccgtggccgcgacgtcctggcaggaggcggcgggctcggtggcatgttggatgaaggccgccgctgccctccctcggcgatcgtcgcggccctcggaggcggggttcttcctctcccgggttcccggccctggggctccctccaggcgggttccgggccctgggggccccctttgaacccctttgaatggggaaaccggacccccccttacagggcttgggtttgacccccaaaaaaaattggggttttttggggaaaaaccgctttggga

SEQ ID NO: 34423 - protein, 41 aa, Zea mays
  misc_feature: Ceres CLONE 1412984-F
MKAAAALPRRSSRPSEAGFFLSRVPGPGAPSRRVPGPGGPL

SEQ ID NO: 34424 - DNA, 753 bp, Zea mays
  misc_feature: Ceres CLONE 1412986-F
  misc_feature: Encodes the peptide sequence at SEQ ID NO. 34425
  misc_feature (686)..(686): n is a, c, t, g, unknown, or other
aagctggagctccccgcggtggcggccgctctagaactagtggatcccccgggctgcaggaattcgcacgagaccattacctagaacatcctaatcgaaaacatagagatagagatagacagctagcttcatcagtaggatgggcagcgacgaggaagcggcgctgctggtgccggcggtggaggagggttgccccgggtgcgtgatggagcggcggaaggcgagcagcaacggcaggatcccctacagggagctgttcttcgtcgccgccacctccctcgcctcagctttaccgatcacgtgcctcttccccttcttgtatttcatggtaagggacttccgcgtcgctgaaacagaggaagacatcggattctatgctggttttcttgctgcgtcgtacatggtgggcagaggcttctcttccatcttctggggcgtcatcgcagaccgcgttggacggaagcctgtcatcacgttttcgataactggccgtggtcgatatcagcgccgctgtttgtcttgagcacgccgtactggggatggcgatcgccacgagggctccgtgctggggcgctctcacggcttgctcgcccggataaggcggaccggggggtttagaagtttgccagacccagcaaaaggcgcttgggaactctcgcttgtgaacacggaatgggcctctgggncctccattggtggccccaagcttctgggggagctacctttcgcagccagctgagaaaatattccccc

SEQ ID NO: 34425 - protein, 127 aa, Zea mays
  misc_feature: Ceres CLONE 1412986-F
MGSDEEAALLVPAVEEGCPGCVMERRKASSNGRIPYRELFFVAATSLASALPITCLFPFLYFMVRDFRVAETEEDIGFYAGFLAASYMVGRGFSSIFWGVIADRVGRKPVITFSITGRGRYQRRCLS

SEQ ID NO: 34426 - DNA, 760 bp, Zea mays
  misc_feature: Ceres CLONE 1412988-F
  misc_feature: Encodes the peptide sequence at SEQ ID NO. 34427
  misc_feature (560)..(560): n is a, c, t, g, unknown, or other
  misc_feature (606)..(606): n is a, c, t, g, unknown, or other
  misc_feature (678)..(678): n is a, c, t, g, unknown, or other
  misc_feature (686)..(686): n is a, c, t, g, unknown, or other
  misc_feature (687)..(687): n is a, c, t, g, unknown, or other
  misc_feature (728)..(728): n is a, c, t, g, unknown, or other
tggagctccccgcggtggcggccgctctagaactagtggatcccccgggctgcaggaattcgcacgagaccattacctagaacatcctaatcgaaaaaatttccagacggcagtccactggtttttgcttgcatatcctttgtgtaggccagagttgagttgtgttccaacttccaagtcttgggttgcggaatcgccggtctcgctcaatcgatgtaaaaccataatccattacattctcaaattgctgaagagaaaatggacatctcagcatcagcttctgttgcatcaggaaacaaattctgcaagggtggcgcctgtgatttctctgattccagtaactcctcgaaagatgccaaggagagatccacgtccatgaggaagcttataatcgcagtgatcctttgcatcatattcatgacttcggaagtggtcggtggcatcacagcaaacagtcttgccatcttaactgatgcggcgcagcttctttctgatgtggcagcatttgccatatcgttattctctctctgggctgctggatgtgaagcaccacgcagaangtcatatgggttccttcccggattgaaatttctttggtgccttggntctcattcagctcatatgggctacttgcctgggatactgggtatatgaggctatggggaaggctcattacgnaaaagggnncgatgtgcagggctcctccatgggtggggggggggcggggnttttgggaatgtttgccaattttaaaaagggt

SEQ ID NO: 34427 - protein, 131 aa, Zea mays
  misc_feature: Ceres CLONE 1412988-F
  misc_feature (101)..(101): Xaa is any aa, unknown, or other
MDISASASVASGNKFCKGGACDFSDSSNSSKDAKERSTSMRKLIIAVILCIIFMTSEVVGGITANSLAILTDAAQLLSDVAAFAISLFSLWAAGCEAPRRXSYGFLPGLKFLWCLGSHSAHMGYLPGILGI

SEQ ID NO: 34428 - DNA, 740 bp, Zea mays
  misc_feature: Ceres CLONE 1412990-F
  misc_feature: Encodes the peptide sequence at SEQ ID NO. 34429
caaagctggagctccccgcggtggcggccgctctagaactagtggatcccccgggctgcaggaattcgcacgagaccattacctagaacatcctaatcaaaaacatttcctctctctctttctctaactccgggtccctctctcctctctctattctctccatccttgcttctgggaagctcatcagccatggacgatgccactgcagaggaagaagcttccatgttcgagaccagccatgtcctcggcgccctgctggcctcctcgccgttgctggcgcgcgcctgggaccgctgcacagccgcctccgccgcagcgccgtggttcgttcacggcgaagacggcggcaaggtgtacgtggggttctctggggtgcaggctgcgcttacggcggcaggcgcggcggtggccggcggcgcccccgacatcttcgcgccggtgagtctcggcggggacgcggcggggcggatgttcgccgcgctggtcgcccccgagcccgacccggccgctaccggggagccggttgccgtgccagcgctggcgctgcagtgcttcctgaaactctgctgccagcctgattttcagatgcctctgaatcagatcaagggcaagggaagtcgtggttcacgggccactccccttggtggggcccgttggggccctcacgggggctacactacctctgcatctcaacgacaagttcgccacctgctccccctggccctggggggcaccctttg

SEQ ID NO: 34429 - protein, 183 aa, Zea mays
  misc_feature: Ceres CLONE 1412990-F
MDDATAEEEASMFETSHVLGALLASSPLLARAWDRCTAASAAAPWFVHGEDGGKVYVGFSGVQAALTAAGAAVAGGAPDIFAPVSLGGDAAGRMFAALVAPEPDPAATGEPVAVPALALQCFLKLCCQPDFQMPLNQIKGKGSRGSRATPLGGARWGPHGGYTTSASQRQVRHLLPLALGGTL

SEQ ID NO: 34430 - DNA, 659 bp, Zea mays
  misc_feature: Ceres CLONE 1412991-F
  misc_feature: Encodes the peptide sequence at SEQ ID NO. 34431
tggagctccccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctcccaagggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgccgacgcccgcctcggccggttccgggtcatcaccctcggctcctgcgttagcctcttcgggatgtgcctgctgtggctgacggcgatccttccggtgtaaagaacaccccggagtgcgcgccggggcggccggtaggggtgcgcggtgctgccgtggcagctgccgctcctcttcacgtcgttcgggttcatgtccctcggggcgggcggcatccggcccctgaacggtggcgttccggggccgaccagccgggaaaagcgggaaaacagct

SEQ ID NO: 34431 - protein, 114 aa, Zea mays
  misc_feature: Ceres CLONE 1412991-F
MEMSAMEEALPRAMERRKGGLRTIPFIILNEIFEKVATFGLSANMILYLTERYLMTNAFATVVLYFWHAFSNFLPILGAVLADARLGRFRVITLGSCVSLFGMCLLWLTAILPV

SEQ ID NO: 34432 - DNA, 823 bp, Zea mays
  misc_feature: Ceres CLONE 1412993-F
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
gggcccccccccccccccccccccacccntnnnnntgngcacacctttcaaagctggagctcaccgcggaggcggccgctctagaactagtggatcccccgggctgcaggaattcgcacgagaccattacctagaacatcctaatcgaaaaaatccccgcggcctcttccatctcctgctcggcacggcactccggctgcccgaaaaatttcgcacatcccagattcccgcccgctctggttcgcgccctcgtctggttcccttgccaacccggtcattcaacgtcgcagccaccccgcgcggctagggctgggactcgaggcctagggtttggctgtaagtttggcaacacgatggcgggggccgcggaggagagcaccgccgagcgccaggcgacggtggaaccgcgtatgcctgccgacccggccaccacgcccgggaagaagcatcatccaccgaatgagcgcaaatgaaaattgtccaaggggcggaatttcggcccagggttcccacgcccatccatcccaataggcgccgcattagcgcccacaacgagccccccggcgcaaagcgccctaacggcaacaaaaataaacggcaaggccacaaaccctcccggcgttgcccacatacaaaacacccgttggataaaataatccgaggaaacgccccccacctacaacgcgaagaaaaatccccacccttccctggactatagaagaaaatcaaacacatccacacccccaacagcccccccccaccccccccctccctcctccacttacataccacgaccccaccccacgccaataccacaacaccc

SEQ ID NO: 34433 - DNA, 754 bp, Zea mays
  misc_feature: Ceres CLONE 1412994-F
  misc_feature: Encodes the peptide sequence at SEQ ID NO. 34434
  misc_feature (635)..(635): n is a, c, t, g, unknown, or other
  misc_feature (687)..(687): n is a, c, t, g, unknown, or other
  misc_feature (688)..(688): n is a, c, t, g, unknown, or other
  misc_feature (713)..(713): n is a, c, t, g, unknown, or other
  misc_feature (724)..(724): n is a, c, t, g, unknown, or other
aaagctggagctccccgcggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgacgatcctgagtggttcttcttcgcccccaaggaccgcaagtaccccaacggtagcaggtcgaacagggccaccgaggcgggatactggaaggctactggcaaggacaggataatcaaatccaagggcgacaagcgcaagcagcataccatcggtatgaagaagaccctcgtcttccaccgtggtcgtgcccccaagggcgagcgcacggggtggattatgcacgagtaccgcacaccgagccntgagtcagtccgcgagcaagggtgggtatgttcttttatcgctcttccgtanngcagaggagaaactgagcgctcagnccagaggaaantggatagagtgctactcactaactcttcct

SEQ ID NO: 34434 - protein, 187 aa, Zea mays
  misc_feature: Ceres CLONE 1412994-F
  misc_feature (12)..(146): Pfam Name: NAM Pfam Description: No apical meristem (NAM) protein
  misc_feature (148)..(148): Xaa is any aa, unknown, or other
  misc_feature (165)..(165): Xaa is any aa, unknown, or other
  misc_feature (166)..(166): Xaa is any aa, unknown, or other
  misc_feature (174)..(174): Xaa is any aa, unknown, or other
  misc_feature (178)..(178): Xaa is any aa, unknown, or other
MVEMSVVELRTLPLGFRFHPTDEELVTHYLKGKITGRINSESEVIPEIDVCKCEPWDLPDKSLIRSDDPEWFFFAPKDRKYPNGSRSNRATEAGYWKATGKDRIIKSKGDKRKQHTIGMKKTLVFHRGRAPKGERTGWIMHEYRTPSXESVREQGWVCSFIALPXXRGETERSXQRKXDRVLLTNSS

SEQ ID NO: 34435 - DNA, 653 bp, Zea mays
  misc_feature: Ceres CLONE 1412997-F
  misc_feature: Encodes the peptide sequence at SEQ ID NO. 34436
aaagctggagctccccgcggtggcggccgctctagaactagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggcggctccatccgccctctctccccagaggaagccgtagctgagagcgactgcaaggtttccagaatatacggggtggtaggcaccataagattgctcgctggaagctatgtactcgttatcacttctcagaaagatgctggctcttatctgggctcccctgtgtaccaagtgaactcaatgaaattcttatgctgcaacgaggctatcaagcacttgactccacaggaaagaagggatgaggcatacttcatgtctctcctgagaatggagaaactacttgtggattgtattattcatacgacagggatttgacactaaacttgcagagggcatccaaggtgg

SEQ ID NO: 34436 - protein, 155 aa, Zea mays
  misc_feature: Ceres CLONE 1412997-F
MANADADEAPLLSVEHLRPGSCSRELELREFRDRYVIRSLDGAAAFAVLRSGGSIRPLSPEEAVAESDCKVSRIYGVVGTIRLLAGSYVLVITSQKDAGSYLGSPVYQVNSMKFLCCNEAIKHLTPQERRDEAYFMSLLRMEKLLVDCIIHTTGI

SEQ ID NO: 34437 - DNA, 694 bp, Zea mays
  misc_feature: Ceres CLONE 1412999-F
  misc_feature: Encodes the peptide sequence at SEQ ID NO. 34438
  misc_feature (515)..(515): n is a, c, t, g, unknown, or other
aaactggagctccccgcggtggcggccgttctataactagtggatcccccgggctgcaggaattcgcacgagaccattacctagaacatcctaatggaaaaactctcgcttccttccctccctccctcccacgcaaatggtggccgctcgcctccgcctcgcgctgctactctccgtctgcctctgctccgcgtgggcgcgcccacgcctcgagacggccatccgcctgccgtcgcagcgcgcggcggcggccgacgaaacggacgacggcgccgtcgggacccgctgggctgtgctcatcgcaggctccagcggctactacaactaccgccaccaggcggacatctgccatgcataccagatcatgaagaagggcggactcaaggatgagaacatcattgtcttcatgtacgatgacatcgcgcatagcccggagaatccgaggcctggtgtcatcatcaaccatcccaggggtggcgacgtctatgctggggtgccaaaggattacactgggncgagatgtcaacgtcgacattttcttcgctgttctgcttggcaacaaaactgctcctcaggggtggaagccgcaaaggttggtgaacagtgcccccgatgatcaaaatctttgtttccaccgggaccatggggggtcctggtggtctttagaaagactacctatccaattccctttgaa

SEQ ID NO: 34438 - protein, 159 aa, Zea mays
  misc_feature: Ceres CLONE 1412999-F
  misc_feature (50)..(159): Pfam Name: Peptidase_C13 Pfam Description: Peptidase C13 family
  misc_feature: SWISSPROT Homolog: EC 3.4.22.34 Legumain
  misc_feature (127)..(127): Xaa is any aa, unknown, or other
MVAARLRLALLLSVCLCSAWARPRLETAIRLPSQRAAAADETDDGAVGTRWAVLIAGSSGYYNYRHQADICHAYQIMKKGGLKDENIIVFMYDDIAHSPENPRPGVIINHPRGGDVYAGVPKDYTGXRCQRRHFLRCSAWQQNCSSGVEAAKVGEQCPR

SEQ ID NO: 34439 - DNA, 662 bp, Zea mays
  misc_feature: Ceres CLONE 1413003-F
  misc_feature: Encodes the peptide sequence at SEQ ID NO. 34440
  misc_feature (613)..(613): n is a, c, t, g, unknown, or other
  misc_feature (660)..(660): n is a, c, t, g, unknown, or other
ggagctccccgcggtggcggccgctctagaactagtggatcccccgggctgcaggaattcgcacgagaccattacctagaacatcctaatcgaaaaatatagccagttctaatctcaggttgggggaaataggcctcgcgggtcgcaaaccgctctctgctgatttgggatttgggaggcgctcgagttttcaggtaaactatagtttagtgacccatggctcgtactaagcaaactgctcgcaagtccactggagggaaggctcctaggaaacaacttgccaccaaggctgcccgtaagtctgcacctacaactgggggagtaaagaagcctcaccgttaccgccctggaactgttgctcttcgtgaaatccgcaagtatcagaagagcactgacctgctcataaggaagcttccgttccaaaggcttgtcagggagattgcccaggatttcaagactgatcttcgtttccagagccatgcggtgcttgcgctgcaggaggctgcggaggcgtacctggtgggtctattcgaggacactaatctgtgcgcatccatgccaagcgcgtgaccatcatgcccaagacattcagctggctaggaaggatcccgtntgaaagggcctagatcctctattattggctactgggagtggctcgcnaa

SEQ ID NO: 34440 - protein, 117 aa, Zea mays
  misc_feature: Ceres CLONE 1413003-F
  misc_feature (58)..(118): Pfam Name: Histone Pfam Description: Core histone H2A/H2B/H3/H4
MARTKQTARKSTGGKAPRKQLATKAARKSAPTTGGVKKPHRYRPGTVALREIRKYQKSTDLLIRKLPFQRLVREIAQDFKTDLRFQSHAVLALQEAAEAYLVGLFEDTNLCASMPSA

SEQ ID NO: 34441 - DNA, 665 bp, Zea mays
  misc_feature: Ceres CLONE 1413004-F
  misc_feature: Encodes the peptide sequence at SEQ ID NO. 34442
  misc_feature (452)..(452): n is a, c, t, g, unknown, or other
  misc_feature (606)..(606): n is a, c, t, g, unknown, or other
  misc_feature (646)..(646): n is a, c, t, g, unknown, or other
tggagctccccgcggtggcggccgctctagaactagtggatcccccgggctgcaggaattcgcacgagaccattacctagaacatcctaatcgaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctggtgtctgggattacattcggntgaatgtaagtgagctggctggtgaggagctgagtgtttctgagtacttggcattcaagaacagctggtggatggacaatcccacagaaactttgtgcttgagcttgattttgagcccctcatggcctccttcctcctccttccatggcgaaanccctcgggaaagggagggaattcttaaccgaaacttggcngccaagttgtccaggaaaa

SEQ ID NO: 34442 - protein, 167 aa, Zea mays
  misc_feature: Ceres CLONE 1413004-F
  misc_feature: SWISSPROT Homolog: EC 2.4.1.13 Sucrose synthase
  misc_feature (97)..(97): Xaa is any aa, unknown, or other
  misc_feature (148)..(148): Xaa is any aa, unknown, or other
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRXNVSELAGEELSVSEYLAFKNSWWMDNPTETLCLSLILSPSWPPSSSFHGEXPREREGILNRNLAAKLSRK

SEQ ID NO: 34443 - DNA, 782 bp, Zea mays
  misc_feature: Ceres CLONE 1413006-F
  misc_feature: Encodes the peptide sequence at SEQ ID NO. 34444
  misc_feature (379)..(379): n is a, c, t, g, unknown, or other
  misc_feature (380)..(380): n is a, c, t, g, unknown, or other
  misc_feature (512)..(512): n is a, c, t, g, unknown, or other
aaagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctcccgcacgcagaacatcactctgccgccgccccgacacgcgttggctgtgcgcgatgtcatgcgctccacgatcccgtcgcagcccgccgtggnngccggcgtccacgaagaagcaagcgcccgccggcgcgttgcaggggttccctgggcttgaagaaggtggaccggaaggcggtggaattacgtgggggaacagggggccccccaaaaggagaggaaaaggggnggggccccccccccgttggggccccccaaagggcccggccctttgaaaccccccttccccctgcgcggaaaaaaaggggcttcaaaaaaaattgggggggggggagggggttcccaaaagggggtctctccttataggacctaaagagggggggggggggaaaatttttttggggggggggggggggggtgttacaaaaaaaccacttttgtggtgtttggggggcccctccaaaaagaaagaaacccccggtgtttttttattatgtgg

SEQ ID NO: 34444 - protein, 60 aa, Zea mays
  misc_feature: Ceres CLONE 1413006-F
  misc_feature (41)..(41): Xaa is any aa, unknown, or other
MAPAVGLKRSRTQNITLPPPRHALAVRDVMRSTIPSQPAVXAGVHEEASARRRVAGVPWA

SEQ ID NO: 34445 - DNA, 674 bp, Zea mays
  misc_feature: Ceres CLONE 1413007-F
  misc_feature: Encodes the peptide sequence at SEQ ID NO. 34446
  misc_feature (632)..(632): n is a, c, t, g, unknown, or other
  misc_feature (633)..(633): n is a, c, t, g, unknown, or other
tccccgcggtggcggccgctctagaactagtggatcccccgggctgcaggaattcgcacgagaccattacctagaacatcctaatcgaaaatggagaaatctggacagaatgctcatatattgttgtctatgttagtcaagcatcttgaacacaagaatgtattgaaacaaccagatatgaatctagatatcattgaagttacttcacgccttgctgaacactccaaagctcagtcttctatagcactaatgtcttcaataagtgatatggtcaggcatatgggtaaaagcatgcaatccttggccagtgatgcaggtcctggagacaacatggtcaaatggaatagcagatatgggaaagctgtagatgaatgtcttgttcagttgtctagaaaggtcggtgatgctggacctatccttgatacgttagctgtagtactggaaaatatttcgagttctatgattgttgcacggtctactatctctgcagcatatcgcactgctcaaatagttgcatcattgccaaacttgtcacatcagagcaaagcatttcgctgaggcgttgtttcatcaacttcttttagcaatgctctatccagattgtgagacacatttaggagcacatcggattnnttctctgttgttcttggtccctcttccgtttgctcccgttt

SEQ ID NO: 34446 - protein, 155 aa, Zea mays
  misc_feature: Ceres CLONE 1413007-F
MEKSGQNAHILLSMLVKHLEHKNVLKQPDMNLDIIEVTSRLAEHSKAQSSIALMSSISDMVRHMGKSMQSLASDAGPGDNMVKWNSRYGKAVDECLVQLSRKVGDAGPILDTLAVVLENISSSMIVARSTISAAYRTAQIVASLPNLSHQSKAFR

SEQ ID NO: 34447 - DNA, 701 bp, Zea mays
  misc_feature: Ceres CLONE 1413008-F
  misc_feature: Encodes the peptide sequence at SEQ ID NO. 34448
  misc_feature (360)..(360): n is a, c, t, g, unknown, or other
  misc_feature (374)..(374): n is a, c, t, g, unknown, or other
  misc_feature (390)..(390): n is a, c, t, g, unknown, or other
  misc_feature (391)..(391): n is a, c, t, g, unknown, or other
  misc_feature (405)..(405): n is a, c, t, g, unknown, or other
  misc_feature (406)..(406): n is a, c, t, g, unknown, or other
  misc_feature (414)..(414): n is a, c, t, g, unknown, or other
  misc_feature (415)..(415): n is a, c, t, g, unknown, or other
  misc_feature (487)..(487): n is a, c, t, g, unknown, or other
  misc_feature (498)..(498): n is a, c, t, g, unknown, or other
tggagctccccgcggtggcggccgctctagaactagtggatcccccgggctgcaggaattcgcacgagaccattacctagaacatcctaatcgaaaaactgcagtctccagagtctagagacctccaccgtccactccaaagacgagcagcgggcaaacccaagcacccgcccaatccggttcgccttccttctcaccccgcccggactctgcggagagatctggcagcggtggctatgccattgggcgacgacgcggcggcggacttcgcgctgccggacgagctcctggcggcgctgccgcgggacccctacgagcagctggatctggcgcgccgcatcaccgcgctggcggtggcgnggcgggtgtccggnctggagcgggaggcgnngcgcctgcgcgcgnnagccgcgnngaaggaccgcgagagcgccgagctccgggagcgggtggcgctgctcgacgccgcgcttcaggagaccaacgncaggctccgcngcgcgctcgaggacatattaagctcagcagggagcggactcgctggcgcagacgtccaagagctggcacgcgacctgcacaagctggagtcatttcagagcatctgatgcagtcatgcggtgatgatgttcatcaccacagaaaacagtgacttaacaacgtgtgatcggcagtacatcaaagcatctccggggcgaaggggg

SEQ ID NO: 34448 - protein, 122 aa, Zea mays
  misc_feature: Ceres CLONE 1413008-F
  misc_feature (42)..(42): Xaa is any aa, unknown, or other
  misc_feature (52)..(52): Xaa is any aa, unknown, or other
  misc_feature (57)..(57): Xaa is any aa, unknown, or other
  misc_feature (60)..(60): Xaa is any aa, unknown, or other
  misc_feature (84)..(84): Xaa is any aa, unknown, or other
  misc_feature (88)..(88): Xaa is any aa, unknown, or other
MPLGDDAAADFALPDELLAALPRDPYEQLDLARRITALAVAXRVSGLEREAXRLRAXAAXKDRESAELRERVALLDAALQETNXRLRXALEDILSSAGSGLAGADVQELARDLHKLESFQSI

SEQ ID NO: 34449 - DNA, 700 bp, Zea mays
  misc_feature: Ceres CLONE 1413010-F
  misc_feature: Encodes the peptide sequence at SEQ ID NO. 34450
  misc_feature (359)..(359): n is a, c, t, g, unknown, or other
  misc_feature (360)..(360): n is a, c, t, g, unknown, or other
  misc_feature (477)..(477): n is a, c, t, g, unknown, or other
  misc_feature (478)..(478): n is a, c, t, g, unknown, or other
tccccgcggtggcggccgctctagaactagtggatcccccgggctgcaggaattcgcacgagaccattacctagaacatcctaatcgaaaacttttccgcgttcccaccctgccgtcgttgctactcgcatcgagatttgcgcggccgtgtcttgctcgcgcctgctgctctgttgccccccttccttccaaggtcgcgtcagcgcccagatctctcgctcgctcgccggcgccccggctagatctgggcggagctcggaggcggagccgtgcgccagtgtccaagtttggtaagacccaaagcggtgaggaggcgagggaagacgcgcggacgccatggagctggctgtcggcgcggnnatgcggcggtcggcgtccacacctcggctggtcggtgtcggatgacttcgagctcacgcggctgctcagcaagccgcggataaacgtcgagcgccagcgctccttcgacgaccgtgnnctcagcgacgtctcgcactcgggggggtaagggcaggggagggcttcgacggcatgtactccccctggggggcgggcctgcgcctccctcgtccggacgccgggcctccttccggggctgcactcccttcgagccccacccccatcgttcggcgacgcccctggggaggcgcttccgcccgctcccctcgtttttggtttccgcgggccagccccctttgag

SEQ ID NO: 34450 - protein, 168 aa, Zea mays
  misc_feature: Ceres CLONE 1413010-F
  misc_feature (120)..(120): Xaa is any aa, unknown, or other
  misc_feature (159)..(159): Xaa is any aa, unknown, or other
PRGGGRSRTSGSPGLQEFARDHYLEHPNRKLFRVPTLPSLLLASRFARPCLARACCSVAPLPSKVASAPRSLARSPAPRLDLGGARRRSRAPVSKFGKTQSGEEAREDARTPWSWLSARXCGGRRPHLGWSVSDDFELTRLLSKPRINVERQRSFDDRXLSDVSHSGG

SEQ ID NO: 34451 - DNA, 653 bp, Zea mays
  misc_feature: Ceres CLONE 1413011-F
  misc_feature: Encodes the peptide sequence at SEQ ID NO. 34452
  misc_feature (489)..(489): n is a, c, t, g, unknown, or other
  misc_feature (620)..(620): n is a, c, t, g, unknown, or other
aagctggagctccccgcggtggcggccgctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccagnttctacgcgggcgacgtgcacccggagaagctggagggtgttcagctccttcggcaggcgctacgtcgtcacggccagcccccagggttcatggtcgagcccttcgccaggcccttccctagcgccgaacnaggtcgtcgggacccgagctgggaggccggcag

SEQ ID NO: 34452 - protein, 157 aa, Zea mays
  misc_feature: Ceres CLONE 1413011-F
  misc_feature: SWISSPROT Homolog: EC 2.3.1.15 Glycerol-3-phosphate O-acyltransferase
  misc_feature (103)..(103): Xaa is any aa, unknown, or other
  misc_feature (147)..(147): Xaa is any aa, unknown, or other
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPXFYAGDVHPEKLEGVQLLRQALRRHGQPPGFMVEPFARPFPSAEXGRRDPSWEAG

SEQ ID NO: 34453 - DNA, 817 bp, Zea mays
  misc_feature: Ceres CLONE 1413012-F
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (21)..(21): n is a, c, t, g, unknown, or other
  misc_feature (31)..(31): n is a, c, t, g, unknown, or other
  misc_feature (35)..(35): n is a, c, t, g, unknown, or other
  misc_feature (37)..(37): n is a, c, t, g, unknown, or other
  misc_feature (43)..(43): n is a, c, t, g, unknown, or other
  misc_feature (48)..(48): n is a, c, t, g, unknown, or other
nncccccccccnnncnttacncttccccccncccntntacctnccccncccaagctggagctccccgcggtggcggccgctctagactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcggccggttcgcgggcggcgccccgtcgtacaacagcgtgccaccgcccccccgatgagattcagcttcgcgaagcagcgcgcagcaggaaatccccgccccgggatcttttaccgccccaaaggccaaagtgtcctccgcgcctcaacaccgtgcgaccactgaacccgagcggcctccgccccaaaaatcctggaaaaaatccctggggccgccatgtatgtccacctcccccctcccgatacaaccctcctttcaccccctcccccccaccccgcagcaccgagaaaccctgttaccccttctactccccaacacccatacactcaacaggcgagacagcccccccatacacgcgcccccaccagcaaccgtcccccgcaccaacaaacgaatcaccctcatcccaccgttcagccagtctatgcgctggaatagcaaccacaaatccacaacccgcaccccgacccgagtgcgaccccc

SEQ ID NO: 34454 - DNA, 650 bp, Zea mays
  misc_feature: Ceres CLONE 1413016-F
  misc_feature: Encodes the peptide sequence at SEQ ID NO. 34455
  misc_feature (559)..(559): n is a, c, t, g, unknown, or other
aaagctggagctccccgcggtggcggccgctctagaactagtggatcccccgggctgcaggaattcgcacgagaccattacctagaacatcctaatcgaaaaatcttcaaaaactacccacggcccgtctcctcgacctccccgaaaccccacttctcggatcgagactagggttagggtttcgtcactcccgccccgattcgaaccaatccgcctaggcccccgccgcgccatggccgccggttccattgtggtggacttcccctccatgggcgccgccctctgcttccccaacctcgaatcactcctccgagactccgcctcgggtttcctctccgccgtctccgccgccccggcccccggcgccgccgacctcaccaacttccaccgcgtcttctcgcgcgtcctcagcacctactcagacccgccgctcgaggtcgtctggttcttctccgcgctctccttccacgaccgccctgacgacctccggtcactgctccagctcctctccggcttcgcgcttcctcgcctgggggcgccaagcggtcgccctcctcgnccccggtggtctccgagttttccactcaaaatagccggcagggagaccgaggccgccgtcaagggtgtccttagttactttaggatttgga

SEQ ID NO: 34455 - protein, 139 aa, Zea mays
  misc_feature: Ceres CLONE 1413016-F
MAAGSIVVDFPSMGAALCFPNLESLLRDSASGFLSAVSAAPAPGAADLTNFHRVFSRVLSTYSDPPLEVVWFFSALSFHDRPDDLRSLLQLLSGFALPRLGAPSGRPPRPRWSPSFPLKIAGRETEAAVKGVLSYFRIW

SEQ ID NO: 34456 - DNA, 647 bp, Zea mays
  misc_feature: Ceres CLONE 1413017-F
  misc_feature: Encodes the peptide sequence at SEQ ID NO. 34457
tccccgcggtggcggccgctctagaactagtggatcccccgggctgcaggaattcgcacgagaccattacctagaacatcctaatcgaaaaacttccaccccggaccgacaaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacggggagcgccaacgacctctacgagtcggcgcagctctacctcagcgcgcgctgcctcgccaccgcgcccgccgtgcgcctgcacaagccgcgccagtcgccgcgccccgtggcgtcgctcccggactcgcacaccaccgacgacacctttccgcggggcccgcgtcaagtggacctccaccacgcgcaccgtcgaccgcagcggcagcggcggcggcggtacccgtacacatattccgccgcggcggcgaccagcgcgg

SEQ ID NO: 34457 - protein, 149 aa, Zea mays
  misc_feature: Ceres CLONE 1413017-F
MEMVLDWRSLGSLLATVVVFRTALRNFLPPEAEMLLRRFLAWVAAAFRPPSDTILIDEADGPTGSANDLYESAQLYLSARCLATAPAVRLHKPRQSPRPVASLPDSHTTDDTFPRGPRQVDLHHAHRRPQRQRRRRYPYTYSAAAATSA

SEQ ID NO: 34458 - DNA, 755 bp, Zea mays
  misc_feature: Ceres CLONE 1413019-F
  misc_feature (387)..(387): n is a, c, t, g, unknown, or other
gctctagaactagtggatcccccgggctgcaggaattcgcacgagaccattacctagaacatcctaatcgaaaaactcgcaccacgccaccgctgctgcctgctcctcacagtcctccccgcgctcgcattgcgattcgcgacctagcgcgagggtaccgggggggtggtgcgcgcgcgtgctcggtgatccgggaagcgccgcgagatgccgtgtgggtggaaggcgtcgttttcccttccgaagcccggctagttcttgtcgcctcccgtctttggatcggtcccctgcgggcctcctactgcctcccctctccctccccccgtgcacctgaccaccgtatctattttgtgcatccattattattggtggtcgtgcctggttacnccttggtgattatacccagccggcgcggcgggttcaggaatggggcacagataagtcggccgcccccatacgccacccacgtcaccgccgccatgggatttaccccccctccactatccccccccccctacccacccccccccagcaccatgtgccactagacgcaggagcgtgtcgaggagccgtcgcgctttgctaccaccccatcgccaccccacaatcccttctcattccctttccctctcccccacccctcactatattgtgaggcgggtaatgttgacctctgtgtgggtgcctcgtgtgctgctttggctccctgcacttatctagaataatacactataattccaattgcgtgaccgccc

SEQ ID NO: 34459 - DNA, 626 bp, Zea mays
  misc_feature: Ceres CLONE 1413020-F
  misc_feature: Translation starting site: 194
  misc_feature (394)..(394): n is a, c, t, g, unknown, or other
aaagctggagctccccgcggtggcggccgctctagaactagtggatcccccgggctgcaggaattcgcacgagaccattacctagaacatcctaatcgaaaaaccggccaccgcgaatccagagccccacgccccgtccgaaccccagagcagagcaaagcctcctcgacctccctgtccccagccttccccgatggcccgcacgaagcagacggcgcgcaagtcgacgggcggcaaggcgccgcggaagcagctggcgacgaaggcggcgcgcaagtcggcgccggcgacgggcggcgtgaagaagccgcaccgcttccgcccggggaccgtcgcgctgcgcgagatccgcaagtacagaagagcacggagctgctgatccgcaagctcccgntccagcgcctggtccgcgagatcgcgcagggactcaagaacgacctccgctttccagtcctccgcctcgccgcgctgcaagaggccgccccaggcctacctggggggcctctttcaagaacaccaacctcctggggcatccccgcccaagggcggtgaccctcatggcccaaggaaatcccgggttggcgcggcgcaatcccggggggagcgcgcctaagagggggtttggg

SEQ ID NO: 34460 - DNA, 819 bp, Zea mays
  misc_feature: Ceres CLONE 1413021-F
  misc_feature (8)..(8): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (44)..(44): n is a, c, t, g, unknown, or other
ttcctttnttttnccnnttctctttcctctccctcttaaagtangaataaaaactggtgctccccgcggtggcggccgctctagaactagtggatcccccgggctgcaggaattcgcacgagaccattacctagaacatcctaatcgaaaaacgccaaagatttcctcttccgcctgcgcttccctttgccccgctctcccccagcctcgctcgccatataatacgggccggccggccggccagctgggtccccgcggatgggctcggtctcgcggggctagggtttggtcggtcgtctcgccggcgtcgaggccgccagcgctgctagctagctctctcgcgttagggttccccgtagccatggtgctgcagcgcttctcgtggccgtacgggggccgaagcgcaaccttctgcggtagcttcaccggttgggagagagtgtcccatgggaactgattggggaccggggtctccaggacatccttcaatcctggcccccggaaggttaccaaaaaaccggttttatgggcgggcggcgtccctcgccccgcccgtccggaacccgcgggccggttttggttaccgaggtgtaatagggggacagataaaacatattataacccgcccgtcaaacacacaaccacaaacacccccctgttgaacgacgccacacagtccgtgcccacccgcaatgacaatcgtgaacaggagagagggggaacccgccctctgaaaagaaccaccgccccccgggtaacaaaaaaagcaagacgcaagcccaccgcagagaagaaagcaagagaaggctaggcgcggcc

SEQ ID NO: 34461 - DNA, 722 bp, Zea mays
  misc_feature: Ceres CLONE 1413023-F
  misc_feature: Translation starting site: 285
  misc_feature: SWISSPROT Homolog: EC 2.7.11.1 Non-specific serine/threonine protein kinase
  misc_feature (722)..(722): n is a, c, t, g, unknown, or other
aaagctggagctccccgcggtggcggccgctctagaactagtggatcccccgggctgcaggaattcgcacgagaccattacctagaacatcctaatcgaaaagttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaccccacctccagtacgagaaggaccccaagatcaaggaaggcctccccgccaaggttcaccgaatacccccggcggcgcgaagaaaatccgggcggtccctccaaggaggggggggcaaggccctgggccccaaacggggggaaaaaatttgggtctccacgcgccccaaagaacagggggctaggcgggcgatgggggagcagaaggccgtgaacacttcttataaatcccccggtggggtggcgaggccccccacccacatcaaactaccccgaacaccacataacataagacggaaccacctgccccccctgtcn

SEQ ID NO: 34462 - DNA, 728 bp, Zea mays
  misc_feature: Ceres CLONE 1413025-F
  misc_feature: Encodes the peptide sequence at SEQ ID NO. 34463
  misc_feature (398)..(398): n is a, c, t, g, unknown, or other
  misc_feature (466)..(466): n is a, c, t, g, unknown, or other
  misc_feature (532)..(532): n is a, c, t, g, unknown, or other
  misc_feature (540)..(540): n is a, c, t, g, unknown, or other
  misc_feature (564)..(564): n is a, c, t, g, unknown, or other
  misc_feature (609)..(609): n is a, c, t, g, unknown, or other
  misc_feature (611)..(611): n is a, c, t, g, unknown, or other
  misc_feature (637)..(637): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcaaaaattccctccctagcccagccagggaaccagtctcagtgaatcccgcgcccggatcaatctcgcccaaggaagcagctcttcacgacttgcttccagatccatccatccatccatccgaggttgggccgtgggggtgtcggtgcggtgggaaatggggaaggggatcagcggcgacgcccgcctcgcctcggcgccttacgaccagtgggtgctgctgagccccgccgggggctcgccgcgcccgcccgcgcgctacaagcatggctgcccaagtggttcaagacaagctgtacgttngtcggagggagtcgcaacggccgtcttctaatcggacgtccagggttttttgattttaagacatcctncttggtcagcgttaagccctgctagaggctcaaaacatcccaaccatggaaatgatgccaacaggntggatcgntccccagcattagcaggccacagntatgggtcaaagtgaaaaaactatcctcctggggcgtagctgggnangcacaaggtcggcatcatcatttaantaaagggttccagtttggncttattgatgggaaggccatagcttggccggctgttgaaacttaagggaaaagttccaacgggtcgagatgt

SEQ ID NO: 34463 - protein, 58 aa, Zea mays
  misc_feature: Ceres CLONE 1413025-F
  misc_feature (49)..(49): Xaa is any aa, unknown, or other
MGKGISGDARLASAPYDQWVLLSPAGGSPRPPARYKHGCPSGSRQAVRXSEGVATAVF

SEQ ID NO: 34464 - DNA, 711 bp, Zea mays
  misc_feature: Ceres CLONE 1413026-F
  misc_feature: Translation starting site: 314
  misc_feature (418)..(418): n is a, c, t, g, unknown, or other
  misc_feature (420)..(420): n is a, c, t, g, unknown, or other
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
  misc_feature (549)..(549): n is a, c, t, g, unknown, or other
ggagctccccgcggtggcggccgctctagaactagtggatcccccgggctgcaggaattcgcacgagaccattacctagaacatcctaatcaaaaaacctcacaagtaaagcagcagcagcagaccttcttgacctagcaagcaatggggccgccgttcctccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacaatgtggtcgtcaatgtgctcaacagcttagacgagcccctgctcatcacttggggatgggatccagcagcgcaagaatgctgncnangatgnngttctcggcaccacctgccccatacccgcaggttgggactgcacctaccactcccagctcaagggacaaattgggagttccttcactcccacccctggaaatgaggggcccccgggggggntctcggaggattcccgggaaacaaccgggggtttttttggggcctttttgaaacccccaggggggaccaccccctctttcccgggaggtggaaaaagaagaccccccccccctggaaaaaatctccccaacccacaaaaaattgggtattcacaaaagtttt

SEQ ID NO: 34465 - DNA, 513 bp, Zea mays
  misc_feature: Ceres CLONE 1413027-F
  misc_feature (190)..(190): n is a, c, t, g, unknown, or other
  misc_feature (191)..(191): n is a, c, t, g, unknown, or other
  misc_feature (203)..(203): n is a, c, t, g, unknown, or other
tcacccgcggtggcggccgctctagaactagtggatcccccgggctgcaggaattcgcacgagaccattacctagaacatcctaatcgaaaaagagcaacgcccaggcacacacgacacgaaccaggcagccagccgcggagggaggaaccctagcggaacaggtgacggcggcgcgcaaccggtgacgnnggatacgggggnaatcgtccccctccctccatcccccgggggggggggggcccagaaacccggcctgggagggttggttttaaaaaaccccccccttttattttcccaggggggaaccccccgtttttttttcccttttcccaaaaaaaacccgtgggggggggcccctttttcctcaaagggggggggagaaaaaaaaaaccccccgcggcggggggtgttttggtttcttacaaaaaaaagggggggggggcccccccccccagggggggggggggggggggccccccccccccccccccccccccccccccccgggggg

SEQ ID NO: 34466 - DNA, 624 bp, Zea mays
  misc_feature: Ceres CLONE 1413029-F
  misc_feature: Encodes the peptide sequence at SEQ ID NO. 34467
gctctagaactagtggatcccccgggctgcaggaattcgcacgagaccattacctagaacatcctaatcgaaaagttgggtgccgtgcgagctccaagtacccctgtctccctcccgtcttgcgggcttgcctttgcctgttccatttccggctcctccagttggtagtgtcgtttcaatgcgagacgccgtccttcacgagcttgattgcccttgaaagcgaagttggtgttggtgtcgttgccggtgaggaggaagaggggatatatggctcccacggaagaggcagcaggggaggacgagcggctgctgaaggatcttctcgcttcttcgtcagataaggaaggagaggatgaagagagtacaaagacacagtccgatgaatctactaagggggggattgtgataaaggggggggtccgtagccgcccttatcgaagtgaaaaatggccaatgataaggcatgggaagggaccggcaacagcccaatgtgcttgaatctggatggtggcttggaggtcaaggtggcctgggaacaagggtcccaaaagcaaacaacgatgaatgggggggggtttaaagggccctccaaacccgggtcccaaaaagccggtaatggttgaa

SEQ ID NO: 34467 - protein, 76 aa, Zea mays
  misc_feature: Ceres CLONE 1413029-F
MAPTEEAAGEDERLLKDLLASSSDKEGEDEESTKTQSDESTKGGIVIKGGVRSRPYRSEKWPMIRHGKGPATAQCA

SEQ ID NO: 34468 - DNA, 896 bp, Zea mays
  misc_feature: Ceres CLONE 1413030-F
  misc_feature (13)..(13): n is a, c, t, g, unknown, or other
  misc_feature (14)..(14): n is a, c, t, g, unknown, or other
  misc_feature (30)..(30): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ttttttttttttnnttttttttcccccgcnaccanaaaaacannnntttaaaggtggagctccccgcggtggcggccgctctagaatagtggatcccccgggctgcaggaattcgcacgagaccattacctagaacatcctaatcgaaaaaccgcgccgctctctctctctctctcgcacgagccgcgccggcgccgccaccacgcgcgcgggagacagagaccacagccgcagccaccggcgggcggaataggaatggtgccgccgggtaaagaagcaggaggaggtccgtcccgttgtcccgccccgcaaggaggaaagaggcgtgaatattaattttccgagggccccacctgataatgaaaccaacccgaacaaaatggaaatggggaactcgtcctttggccacacgttggaatgaaccccccaatggggaaaccccccatctttgacagctggccccggaagaaaagcgcgcgtgcaacgatccagcggggaagcgcccacagaaaaagtaacggttaatgttcttcggataggccttggccccccaaccaaaaaaatcgggcccctctttgctgcgcgcccccccatttagcatactcatctcttcggcctctacatacatcccaccgcgccaaacacagccccacaaaaaagagaggagaatcaacggagctgtggggtcgtcgcgtagaccacggcaagagagcgttcccatttaagccccctcccccgggccccgcgccacccccccccggccgcggccgccctccatcgccgcgcgcgggacgggggtgggacaccacaacgaggagatcagatgtataatgcatgaattcactagggaggacggacgccgacccgggggcccgcaccggccagcggacaacccg

SEQ ID NO: 34469 - DNA, 696 bp, Zea mays
  misc_feature: Ceres CLONE 1413037-F
  misc_feature: Encodes the peptide sequence at SEQ ID NO. 34470
tccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtccccgcggggtacaatgccccgcagcaggtgcacatcacgctgggtgaccaggagggcacggcgatgatcggggcgggggtgaccgccaatgaactggccacagccccgtcatgaccgggagggcgtcccggaaccggaaaaaaaggagctcccggcggggggcccccaacggggtaaaaataatttaaataaccccccggttttttccccccggggcccctccaaacccctgggttaggccccaggattatcccgcccggggggtcccgcacccagggggggggtttttggtttcccccgccccccggggggggccccggggggtccttaaatagtggggacattgtcggaacctgttcccaccgttttcccg

SEQ ID NO: 34470 - protein, 92 aa, Zea mays
  misc_feature: Ceres CLONE 1413037-F
  misc_feature: SWISSPROT Homolog: EC 3.1.3.2 Acid phosphatase
MSNMLRARRRLDLLQVVLFAAVLLVVVADAGVTSQYRRKLEATVEMPLDADVFRVPAGYNAPQQVHITLGDQEGTAMIGAGVTANELATAPS

SEQ ID NO: 34471 - DNA, 702 bp, Zea mays
  misc_feature: Ceres CLONE 1413038-F
  misc_feature: Translation starting site: 179
  misc_feature (511)..(511): n is a, c, t, g, unknown, or other
  misc_feature (577)..(577): n is a, c, t, g, unknown, or other
aaagctggagctccccgcggtggcggccgctctagaactagtggatcccccgggctgcaggaattcgcacgagaccattacctagaacatcctaatcgaaaaatccattcacaacttcagctgcgcctcgactcgtagcccgaaccctagccaccaagccggaggcgagagagcagccatggcgcggtgcctcgcgctcgtcgccctcctcgtactcggcctcgccgccgccgccgcctccgcggccgacgcgcccttcgtcgtcgcgcacaagaagatttcgctctcccgccccaagccgggcgtcaggcgcgtcgccgtctccgtcgacctctacaaccagggatccgcgactggcctatgatgtgtccattaatgacgactcttgggccaacagaagtggtttgagcttgtcactggagagaaatcgaaagacattggaaaggtttggaccctggtgccactgcttaacacacatattgtcctggagacaaaaacccagggcaggggnttccaagggttcaccagctatcattaacttacccgtgttcccacaaagacagcttcttcaggaggnatactcaactcccatcttcccactggatattctcgctgagagacccccaaaagaagaaagtttgaatgggctaagaggcttgtgatgaatacgggtccctttggggctggtgccctcttttggtg

SEQ ID NO: 34472 - DNA, 694 bp, Zea mays
  misc_feature: Ceres CLONE 1413040-F
  misc_feature: Translation starting site: 221
  misc_feature (408)..(408): n is a, c, t, g, unknown, or other
tccccgcggtggcggccgctctagaactagtggatcccccgggctgcaggaattcgcacgagaccattacctagaacatcctaatcaaaaaagacagacgcagactctctcacccgactcgtcagacgtcagccagcagttcgaaaccaaggatcgatccaggagcttccggaaggcgaggcgcgcgcgcagcgtcgaggtgctggtgccggtgccgcccatggatcgggctcgcggatccgcgttcctgctcggcgtcctgctcgcaggatccttgttcgcgttttcagttgccaaagaggagaccaagaagctcgggacccgtgatcggtatcgatctcggtaccacctactcctggtgtcggtgtgtacaagaacggtcattgtcgagatcatcgccaatgaccnaggtaaccgtatcacacccctcatgggttgccttcaccgatagcgagagctccttcgggtgaggctgccaagaaccaggcagccgtcacccctgagaggaccttctttgacgtcagcgctcattccggaagaaagttcggggacaaagaaagtccagagggactttgaaacttgttccctacaagatattaaacagggatgggcagccctacttttcgggccagagattaaggtatggggacacaccaaggtcttccccccccgaaggccccaccccggcccctca

SEQ ID NO: 34473 - DNA, 623 bp, Zea mays
  misc_feature: Ceres CLONE 1413041-F
  misc_feature: Encodes the peptide sequence at SEQ ID NO. 34474
  misc_feature (382)..(382): n is a, c, t, g, unknown, or other
  misc_feature (418)..(418): n is a, c, t, g, unknown, or other
  misc_feature (419)..(419): n is a, c, t, g, unknown, or other
  misc_feature (542)..(542): n is a, c, t, g, unknown, or other
tccccgcggtggcggccgctctagaactagtggatcccccgggctgcaggaattcgcacgagaccattacctagaacatcctaatcaaaactcgcgttccatttgcttcggctcatctcagatcaagctagcgcacctgacacccaccacctccctcccagatccaccaccccagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcacctgttgactccnacggtgggcccatccttccgccgcccaccgagatgnngccgcgaggagggattcctgctccgcgagtggtgccgacaaaatgctattcaccttgaggaaaaagagaagaaggagaaggagctgaggagccaaatcatcgttgattgctgaagagtttaangaaagcttttggtgaggaggagaaagctcaatgctgaaaacaagcaaggggccaaaaccgtggaacaggggagaaagcttt

SEQ ID NO: 34474 - protein, 99 aa, Zea mays
  misc_feature: Ceres CLONE 1413041-F
  misc_feature (69)..(69): Xaa is any aa, unknown, or other
  misc_feature (81)..(81): Xaa is any aa, unknown, or other
MATAFDSPTSSPAAAPFHDDPFLHFDGSAPAAADGFPASPDAYAPSPFGMPHSNGDLHDDPFAAPVDSXGGPILPPPTEMXPRGGIPAPRVVPTKCYSP

SEQ ID NO: 34475 - DNA, 715 bp, Zea mays
  misc_feature: Ceres CLONE 1413043-F
  misc_feature (388)..(388): n is a, c, t, g, unknown, or other
  misc_feature (456)..(456): n is a, c, t, g, unknown, or other
  misc_feature (508)..(508): n is a, c, t, g, unknown, or other
  misc_feature (639)..(639): n is a, c, t, g, unknown, or other
  misc_feature (640)..(640): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
aagctggagctccccgcggtggcggccgctctagaactagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggtttagctggggcctctgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctnctgaccgggtgttgcagatcgagatcgtcgctgggggatgacgccctcggggccaagggcgcaccggncgaggggtgctcatctcttgccgactgggcgtgccacgcaagcgacgacggnaggagctccgacgcgacaagaatctagaaatacatggcagatccagcaactggcaagtgaagctgaagaattgatgcctacgaggaaggcatgagctgtacttatgatagaagatctcgctgaattgagcnnaaggggtgaggatgaaaaacacgctcaacggnnnnaatgggggggaccccggttttggagagtaagctatgaacc

SEQ ID NO: 34476 - DNA, 740 bp, Zea mays
  misc_feature: Ceres CLONE 1413044-F
  misc_feature (299)..(299): n is a, c, t, g, unknown, or other
  misc_feature (338)..(338): n is a, c, t, g, unknown, or other
aagctggagctccccgcggtggcggccgctctataactagtggatcccccgggctgcaggaattcgcacgagaccattacctagaacatcctaatcgaaaaagctccactccaccacacacaccgcgcagctagctgtcaccggagcaagaaggaagaaaaaccagcggcaccgatcgatcgacgacacgcgcgcgatcgaggtgaggagcgaaagaaaaggtggccttttcgaagccgccggacggagtgtagcgctagctagctccccaggccggagaggaggatgggtggacgagnagccgcgacggcccctctgtgggcggcggtggttgccgntcgccaacgtggttgccccgggcgcaacagctgccagggggggttctacaacacgctgggcccgggggccggacatcctcctgccaggaggaggtgagcaaaggcgggggtccggaaaccccggggggccccccgggggctccctgggcctcccacttccacgaatggcttccaccaagggcccagggcgccccgccgcttaattcattaagcaaagctaagttagccgcccctccctcgatggtccaagtgggaaagggggtttgcggggggcctccggacctacatcccaccctctccttgtactactccctcccacccccccccgcccccgcgcgccggcgcgggatcgccccaactcccctacccccaccgtcttcctccgtatcaaccaataatcac

SEQ ID NO: 34477 - DNA, 635 bp, Zea mays
  misc_feature: Ceres CLONE 1413051-F
  misc_feature: Pfam Name: DTW Pfam Description: DTW domain
  misc_feature (285)..(285): n is a, c, t, g, unknown, or other
  misc_feature (343)..(343): n is a, c, t, g, unknown, or other
  misc_feature (350)..(350): n is a, c, t, g, unknown, or other
  misc_feature (463)..(463): n is a, c, t, g, unknown, or other
  misc_feature (466)..(466): n is a, c, t, g, unknown, or other
  misc_feature (494)..(494): n is a, c, t, g, unknown, or other
  misc_feature (635)..(635): n is a, c, t, g, unknown, or other
ggagctccccgcggtggcggccgctctagaactagtggatcccccgggctgcaggaattcgcacgagaccattacctagaacatcctaatcgaaaacagtcccctccgactgcgacgacggcgatggcggcgtcgccgccgcctcctcctcctctcccggccgttccatctgccacgccggctgtggccgcccgtcccgcgtctgcctgtgcccgtacctccctgcctcccctctccagacctccacgaccatcgtcatcctccaccacccgcacgccctccggnggaacccgctctcaacgctgcccctcctcgcgcgctgcctctccaacctccgcctcgntccgggncgccgcctcctcccctcctccaccgctcccgccccgggccccgtcctcctgctctacccgtcgcccgccgcctccgacctcgtctcctggtgccggtccacgccgcggcccgnggngccgcccccaccttcctctcctcgaggncacctggaggcaggccagggagatgcacgcggccagcctggccgtggtcgcgtcttcttgggggcggtcccccgtcgcctccccgtcaacgccgcgccgacgaggacagtatgttccagtccgacctccgtgggggaagan

SEQ ID NO: 34478 - DNA, 646 bp, Zea mays
  misc_feature: Ceres CLONE 1413052-F
  misc_feature: Encodes the peptide sequence at SEQ ID NO. 34479
  misc_feature (334)..(334): n is a, c, t, g, unknown, or other
tggagctccccgcggtggcggccgctctagaactagtggatcccccgggctgcaggaattcgcacgagaccattacctagaacatcctaatcgaaaagggaaacaaagcgaagttggggcggcgagacgcgagacgcgagacgcgagaaatggcggagccgcctttggccgccggctgccacgacaaactggaggagggaggcggatgagcggctgcggagcctccactccctcctcttcggcgccgacgccgcactcgagcacggggacgccacggaggcgcaggcgctcgcgctccgcctcctcggcttcctcgactctcaggggctagccngcaggcgcagggccccgaggacgccgtcttcgtcgcgcccattggcaccgcggcttccgctcggctagccgccgcctcacgcgcccgtgcctctgactccgaccgtgcagttttttgagcttgcaagaacggatgtacgcctgctgttgtgcaaatcatgggtgaccatagtgttgaaagaatccagcgatcgaaggatatccaagctctgcttcacaagtctagagttgacgtttctgaacgacgaaatgcaacatggcaagagtactcagaacactgagctccatgattcgatggaaagcgagctgaaat

SEQ ID NO: 34479 - protein, 40 aa, Zea mays
  misc_feature: Ceres CLONE 1413052-F
MGDHSVERIQRSKDIQALLHKSRVDVSERRNATWQEYSEH

SEQ ID NO: 34480 - DNA, 633 bp, Zea mays
  misc_feature: Ceres CLONE 1413053-F
tccccgcggtggcggccgctctagaactagtggatcccccgggctgcaggaattcgcacgagaccattacctagaacatcctaatcgaaaaagcctttccctctcttctctgctctttgcatctctctcttgttcctcccttcctctctaaaaaaagggttctgatccctttctagaagctcctgggtttctgttgccgacccgagctccccaggggcgctcaggaggcgccgagccggcgaccgctccggcggatctgaggagccgccgcggtcgctttgcctccgttgcgatactgcacaggttccttgtaaactattgattgggaaacactctgaagaagagtttgttggctgcataacatctcctgaagctggtttgaagtttgctgataggaaagatcatgggcgctctctgtgatttctgtggggagcagaggtctatggtttactgccgatcagatgcagcatccttgtgtttatcatgtgaccgtaatgtgcattcagctaatgctctttctcggcgtcatacaaggacacttttatgtgaccggtgtgcttcacagcctgctatggtccgctgtctaacagaaaatgcctcgctttgccaaaatggtgatgggaatggccactt

SEQ ID NO: 34481 - DNA, 643 bp, Zea mays
  misc_feature: Ceres CLONE 1413056-F
  misc_feature (237)..(237): n is a, c, t, g, unknown, or other
tcagaactagtggatcccccgggctgcaggaattcgcacgagaccattacctagaacatcctaatcgaaaaacgttcactccgtatctctcgtgcctttttcctttcctggttgcgacgagccgacgactgggcggacgccgctgccgccctacgccaggtcttccgtcggccccttcgacgagcacacacaagaattcagtcgggaatgttgaatgcatagtgtaatttctgcgcnaaaagatggcatcagacgagttcatcagccttgacgcaccttgtgaggctgatgcgaaaagatgaaggggagacgttcaggttaaagctcctgatgtgagtgggatggagcctctggtatcggatctcaaccagaaggggaagctggtgctgtggttagtaatcccaagacatctgctgggaacctggatcttgaggaggggcaagtgaaaaaatggacctcgggatgatgaccctagtgggtggaaaggatcagctattagatgctccattcaccccaagatcagtggttgagttgtgaaacttgggatttggtttttggggcaagcgggaaaaggggggacgggaatggaaaatgaaatattttttggggcccaaccggctcctcttttggaaaaaggcccccc

SEQ ID NO: 34482 - DNA, 657 bp, Zea mays
  misc_feature: Ceres CLONE 1413059-F
  misc_feature: Encodes the peptide sequence at SEQ ID NO. 34483
  misc_feature (344)..(344): n is a, c, t, g, unknown, or other
  misc_feature (376)..(376): n is a, c, t, g, unknown, or other
  misc_feature (377)..(377): n is a, c, t, g, unknown, or other
  misc_feature (401)..(401): n is a, c, t, g, unknown, or other
  misc_feature (402)..(402): n is a, c, t, g, unknown, or other
  misc_feature (407)..(407): n is a, c, t, g, unknown, or other
  misc_feature (597)..(597): n is a, c, t, g, unknown, or other
gctctagaactagtggatcccccgggctgcaggaattcgcacgagaccattacctagaacatcctaatcgaaaaatcgcgggctcacatagcaccgcacagctgaggtgcagtttctactagcagcaatatcatggattctgaggtagtgcatgtggtagagtcgtcgtttgtagtgccgagcgagccgacaccgtcggaggggctctcgctctctccgctggacctcgttctgcccagcagaggccacaccccaacagtctacctgtacagcccccagcgatggttgccgccgccgatggttttcttcgacgtgggccaggctcaaggaggctatggccaagnacccttggtggccttctacccccctcgctggnncgcctcggcgtcaacaacgatggnnagggntaagagatcacctggcaccggcgagggcgcaacttcttttgtggtcgctcatgctgaccctccaagtggtggtggaccatcgaggacgaccttcaggccgtcgccggagcttgaggaaaggttggtttgtttccatgcattgagccagcatcccatcatattggcccatacaggtgacctttctccaagnttcgggaaggtgtggtggttaaggaacggctcctccaccatgccgcccagcgatgccctc

SEQ ID NO: 34483 - protein, 175 aa, Zea mays
  misc_feature: Ceres CLONE 1413059-F
  misc_feature (71)..(71): Xaa is any aa, unknown, or other
  misc_feature (82)..(82): Xaa is any aa, unknown, or other
  misc_feature (90)..(90): Xaa is any aa, unknown, or other
  misc_feature (92)..(92): Xaa is any aa, unknown, or other
  misc_feature (155)..(155): Xaa is any aa, unknown, or other
MDSEVVHVVESSFVVPSEPTPSEGLSLSPLDLVLPSRGHTPTVYLYSPQRWLPPPMVFFDVGQAQGGYGQXPLVAFYPPRWXASASTTMXRXKRSPGTGEGATSFVVAHADPPSGGGPSRTTFRPSPELEERLVCFHALSQHPIILAHTGDLSPXFGKVWWLRNGSSTMPPSDAL

SEQ ID NO: 34484 - DNA, 629 bp, Zea mays
  misc_feature: Ceres CLONE 1413060-F
  misc_feature: Encodes the peptide sequence at SEQ ID NO. 34485
  misc_feature (380)..(380): n is a, c, t, g, unknown, or other
  misc_feature (405)..(405): n is a, c, t, g, unknown, or other
  misc_feature (426)..(426): n is a, c, t, g, unknown, or other
  misc_feature (458)..(458): n is a, c, t, g, unknown, or other
  misc_feature (465)..(465): n is a, c, t, g, unknown, or other
tggagctccccgcggtggcggccgctctagaactagtggatcccccgggctgcaggaattcgcacgagaccattacctagaacatcctaatcgaaaaaaccgagacgggaggagaccagcagcagcccatccgaccccccgcctcctcctcctcctcctcccgggttcgcgtgaggctttgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggncgctcgtcgggtggatctccaacgncaccgggctactccgtctccnagcacgtcccgctctgggaggctcgtctgggnttctcgntcgtcgcccacacctccatttaccgggaatgaaacctcaggcttatggttcaaatttcccggggggggatttctacccaaaattcccccaaaaggggggggggggggtttccccccggggggggggggggcctctccccccaccaaaaaaaaaaaaggggggcc

SEQ ID NO: 34485 - protein, 138 aa, Zea mays
  misc_feature: Ceres CLONE 1413060-F
  misc_feature (56)..(56): Xaa is any aa, unknown, or other
  misc_feature (82)..(82): Xaa is any aa, unknown, or other
MEAEKKPPAVSDVGAWAMNVVSSVSLIMANKQLMSSSGYAFAFATTLTGFHFTVTXARRVDLQRHRATPSPSTSRSGRLVWXSRSSPTPPFTGNETSGLWFKFPGGGFLPKIPPKGGGGGFPPGGGGASPPTKKKKGG

SEQ ID NO: 34486 - DNA, 672 bp, Zea mays
  misc_feature: Ceres CLONE 1413062-F
  misc_feature (337)..(337): n is a, c, t, g, unknown, or other
  misc_feature (338)..(338): n is a, c, t, g, unknown, or other
  misc_feature (409)..(409): n is a, c, t, g, unknown, or other
  misc_feature (425)..(425): n is a, c, t, g, unknown, or other
  misc_feature (440)..(440): n is a, c, t, g, unknown, or other
  misc_feature (469)..(469): n is a, c, t, g, unknown, or other
  misc_feature (482)..(482): n is a, c, t, g, unknown, or other
  misc_feature (601)..(601): n is a, c, t, g, unknown, or other
ggagctccccgcggtggcggccgctctagaactagtggatcccccgggctgcaggaattcgcacgagaccattacctagaacatcctaatcgaaaaggggcagagctggcaagtggcaaggctgcgcagccgcagagggactttttgtgtaaaatgcggtgggaaggtgcgctgcacctgcaagcagaggtgtgctctactgacagagtttgaactctcaagaggaggcgaggcagaaccgcaatcgcgaccgcgacccgcaggtgacatacatacggtgcgagcgccggaagccggaagcaccggtgacgaagccttccgtgtcatcactcatcgnngatcttcccggtttttgtttcgtttcggcgggcgttgggaatccatccatggccgaggaagagctctccgnacggggagggtggcgncccgtcccggatggntgggcactatgactacgatctcttcgtcnatcggggcgggcnaggcggcgggcgttcgcgggttctcgcaccgccgccttcctttcggagctaaggttggcgatttgggagctcccattccaccccctcagctcaaaaggggcttagaggaactgggtggnaactggcgtgatacctgggttgcgtacctaaaaaagatactcggggatggggcattctttctgtggaaaat

SEQ ID NO: 34487 - DNA, 663 bp, Zea mays
  misc_feature: Ceres CLONE 1413064-F
  misc_feature (365)..(365): n is a, c, t, g, unknown, or other
  misc_feature (594)..(594): n is a, c, t, g, unknown, or other
tccccgcggtggcggccgctctagaactagtggatcccccgggctgcaggaattcgcacgagaccattacctagaacatcctaatcgaaaatgaacgtgcattggaggcagagcgggtgtcaaacgtcgaattgaggaaaaatattgcaaagtttagaggtcatttgtacaaagagcaggaggcctgacttcggtatgttatagctggttccagaattttacctaagacacctgactaaaggcacaatttttgatatagaagggtatctcggtctggatccattcgaactgagattggcacgtgattgttcgatgacgcatggaatatgcgtctagtggtttgtagaatgcgtagtttgatgtancatgtgttcgtaggtttgagcatgtagagtatggtatccctcgggaaaaaaaaaggagtatggtattcatgtggctgaagactgctgagtattggaacatggtagtgtcttgcgggggtgtaggttctcacgacacaggaggatggagttgcagcactgtactcctcttgacctgtcggaattttgttgtcgaggtgcgacttacgcggtccggaatcccttttacggnagaacaatctccctgtgccgattcttatgacgaatcgcccctcctacctgcagatccacttgacggaag

SEQ ID NO: 34488 - DNA, 661 bp, Zea mays
  misc_feature: Ceres CLONE 1413066-F
  misc_feature (214)..(214): n is a, c, t, g, unknown, or other
  misc_feature (223)..(223): n is a, c, t, g, unknown, or other
  misc_feature (355)..(355): n is a, c, t, g, unknown, or other
  misc_feature (473)..(473): n is a, c, t, g, unknown, or other
  misc_feature (521)..(521): n is a, c, t, g, unknown, or other
  misc_feature (571)..(571): n is a, c, t, g, unknown, or other
gagctccccgcggtggcggccgctctagaactagtggatcccccgggctgcaggaattcgcacgagaccattacctagaacatcctaatcgaaaaaaaaataaaatccaattttctcagtctcgagcgcccgcgtccctcgccccgtcgcgactcgcgacttcgcgagtcgccccgtcccagcctcccagccgtcccggctccccgcgacccgnccctccggncagtccggcgcgggggctccctctccgatccggtgagccgaacgaggatcccaactccccgaagaaagcggccacagcagaagccaggggtggctcggctctcctctcacagactgcgccgcagcgcctaancgctcggctggcagccgctcccggccggtcggccccgcgcccccgcccctgctgcctacatccgcctggcagcccagaagatctgcctccagcgaccgccctgcctgccccttgtggntttctgtggttctgcacaccagcacacgcacttgtccccaacaacggnggggggggatgagtatctcagaagagcttcccggcgaaggatctgacggngaaggaagagttcctcatcacgggggaggactcttccccgagataacattcgagaagaagatctccccgacgggacgacaaaaatgacga

SEQ ID NO: 34489 - DNA, 585 bp, Zea mays
  misc_feature: Ceres CLONE 1413067-F
cgctctagaactagtggatcccccgggctgcaggaattcgcacgagaccattacctagaacatcctaatcgaaaaaagagcgtgcagagcgagacgcgtcgcctcctcccctcccccaccccgccgccgccctcgcgtccgtccgtccgtcccgtaattaaggttcggtcgccgccatggcgatcctctcggcgctcgcccacggagtgctcattcccgtcgccggcgtctcgggatcgccttccccggtgggcaaggggttgtcccttccccccgtaaatttttcccccgcgcgacccgggggtggggttaaaagagccgtaacccaaatccccctttggggggggggaagggggtaaaaacacacaggggccgcgaaagtggccccaaattcctaaagcccttctcccacccaccccatcatctctttttcataagaaccaaatattgtggggactcttaggcgtgttatcacggggcgataataatacaccctagtgaacaagagaagccacccccgcaacaaactgtgccgcgccctatttttccgccgtatcaccaaacactacgatatacccaacgaca

SEQ ID NO: 34490 - DNA, 685 bp, Zea mays
  misc_feature: Ceres CLONE 1413069-F
ggagctccccgcggtggcggccgctctagaatagtggatcccccgggctgcaggaattcgcacgagaccattacctagaacatcctaatcgaaaaagctaaccaagctataccactagaaccagagcacaactcaaagcaatgccgccgcctcctcctcctccgtcccactcccacgcttcccatcccgcgccgtatggacgcgagcagcactaccgcggcggcacacagtacgtgaagcgggagcggatacgacgatggacctcgaaggctcgtgggtgatgcagccgcgcgccccccacatggaccggcgcgggtggggatgaatacgctggtcaagcccgcgcccggtcccaatgccgggtgagaaaacaacggatggggggaacgcgctaagtttcaagaacccaagaaaagggaatgcgccccgtcccaaactggggaaagggggggtttccccccaaggggcgaaggcggcaaaaattcctcgctggggtttccgcatcccccgggaccagcggggaaaacaaaaatgccaaggtttttctgtcacccccccccccctcccccccggactcaaggagcccccccaccccccaaaagcggaaaagagggcctgggggccccaaccaccgcctacctcaacaaaaagccccccggcccatttttgcccccacaaaaccaca

SEQ ID NO: 34491 - DNA, 634 bp, Zea mays
  misc_feature: Ceres CLONE 1413070-F
  misc_feature (90)..(90): n is a, c, t, g, unknown, or other
  misc_feature (164)..(164): n is a, c, t, g, unknown, or other
  misc_feature (251)..(251): n is a, c, t, g, unknown, or other
  misc_feature (255)..(255): n is a, c, t, g, unknown, or other
  misc_feature (296)..(296): n is a, c, t, g, unknown, or other
tccccgcggtggcggccgctctagaactagtggatcccccgggctgcaggaattcgcacgagaccattacctagaacatcctaatcgaanactcttcttcccgcggtctgctcgttcgatctgtgcagcagatctgaggtcccgggcgaccgtgaagcagcttncattgtcggcatggcgctcgtattgcatagtgggggctggaaaacaagaatgccttcaaagcacttattgctgcagaatacagtggnatcnaggggtgagttgaccaaggattttgaagatgggtgctcccnacaagacccctgagtttcttaagatgaaccccccttgggaaaggtccttggtttggaaactcttgatgggcccgggtttttagagaaaaagggtatccccccgcttttttcttccccttaaaggaggacaacccccttttttgggggcccccccccctatggaaacaccccccccttggggcaaggggggggtgtttttctcgccaacaaaaagaaaaccccgggggggggccaaggaaactttattcccccggggttggggacccccccccctttttttgtgccaccccctggggggaaaacctttttttttctttttttagaagagaggggctcgg

SEQ ID NO: 34492 - DNA, 697 bp, Zea mays
  misc_feature: Ceres CLONE 1413071-F
  misc_feature: Translation starting site: 137
aaagctggagctccccgcggtggcggccgctctagaactagtggatcccccgggctgcaggaattcgcacgagaccattacctagaacatcctaatcgaaaaatctagcggcagagaccaaagtgcccatcgcaccatgtcggccgccgaaaccgctgtttctccgacgacgacgccgcagccgcagctgcaatcggatccgaacgccgccgccgacgcggccagttccaattctctctgggtggccgacgagacgcaaaccctaaccgaggtcctgctccaaccccaaccaaaccacctgtcgcctcctccttctggtgaaggggacgacgggatcactggctccggtgctcctgttgggtggggacgccgcggcatctgcttctgctgcggcggcggctaacgcgacgatagaagagcgggtgagggggcccgtgctccccagaggaggacgcggtgctgagcaacctcgtggagaagttcggggcgcgggactggacgctgatcgcgcggggcatcccggggccgtccggaaaatcctggccgcctgggctggtggcaatcagctcgaccccccaagtcaagggcaggccttttcactgaaggaggaggaccgctttaaatggccagctcctgctgcccatgggaaacagggggccttctatcccaaagttttttggatgggaagaacagaaag

SEQ ID NO: 34493 - DNA, 616 bp, Zea mays
  misc_feature: Ceres CLONE 1413074-F
  misc_feature: Encodes the peptide sequence at SEQ ID NO. 34494
  misc_feature (409)..(409): n is a, c, t, g, unknown, or other
  misc_feature (506)..(506): n is a, c, t, g, unknown, or other
  misc_feature (524)..(524): n is a, c, t, g, unknown, or other
  misc_feature (525)..(525): n is a, c, t, g, unknown, or other
  misc_feature (540)..(540): n is a, c, t, g, unknown, or other
  misc_feature (543)..(543): n is a, c, t, g, unknown, or other
  misc_feature (548)..(548): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (583)..(583): n is a, c, t, g, unknown, or other
  misc_feature (590)..(590): n is a, c, t, g, unknown, or other
  misc_feature (604)..(604): n is a, c, t, g, unknown, or other
  misc_feature (605)..(605): n is a, c, t, g, unknown, or other
cagagctggagctccccgcggtggcggccgctctagaactagtggatcccccgggctgcaggaattcgcacgagaccattacctagaacatcctaatcaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgnccggaaacgctggcaagggacaacaaagaaaagcggggattttgcccccggggccaccgaggggggggggggggggggcctcgccccccacacccanggggggggtgtctttggnnaaggatagtcttttntcnccggncgnnncnnnggggccnnnnnnnnnnnnnnnnncgnacgccgnccccggcccccccnncccccgccggc

SEQ ID NO: 34494 - protein, 120 aa, Zea mays
  misc_feature: Ceres CLONE 1413074-F
  misc_feature (31)..(91): Pfam Name: Histone Pfam Description: Core histone H2A/H2B/H3/H4
  misc_feature (80)..(80): Xaa is any aa, unknown, or other
  misc_feature (112)..(112): Xaa is any aa, unknown, or other
  misc_feature (119)..(119): Xaa is any aa, unknown, or other
MDATGTGAGGKAKKGAAGRKAGGPRKKSVTRSVKAGLQFPVGRIGRYLKKGRYAQRVGSGAPVYLAAVLEYLAAEVLELXRKRWQGTTKKSGDFAPGATEGGGGGGLAPHTXGGGVFGXG

SEQ ID NO: 34495 - DNA, 595 bp, Zea mays
  misc_feature: Ceres CLONE 1413075-F
  misc_feature (199)..(199): n is a, c, t, g, unknown, or other
  misc_feature (573)..(573): n is a, c, t, g, unknown, or other
tcaccgcggtggcggccgctctagaactagtggatcccccgggctgcaggaattcgcacgagaccattacctagaacatcctaatcgaaaacagctgaaagcagccaaaacgcagaagctgcactgcatacatcgagctaactatctgcagcgatgtctcgctctgctgcgtcgcccgtgtcggggccttcccgctggncgcgcgacaggcagggccccgggcccgaatggttgaacaaggaggccatgccccggggccgctgtcccaaaggggggaaaggggggggccctccggccccccggggtgcccaaaaggggcccccgcgaaggccaaagggggcattgccacccaggggccacaccaaatcttcggggggggggggaaaacgggggacaccccggggagggggcgggaaaaagggaaaatcttcccccccaccgggggggggcccaaaaaaaaagatttctccggggggggggttccccctcctcgacaacaagggggcgcccccagggagaaaaaaacggtggtgccccccctttggaaaccccggcccgcgccttttttggggncgacacaaccctcttgtaggag

SEQ ID NO: 34496 - DNA, 590 bp, Zea mays
  misc_feature: Ceres CLONE 1413080-F
aagctggagctccccgcggtggcggccgctctagaatagtggatcccccgggctgcaggaattcgcacgagaccattacctagaacatcctaatcgaaaatcgaaaaacatctcccgttcccaccaccaccttcgctccttctgctttcgccgtccccctccgtcgcgtcgactcccaggatggataagctcagtgggtctgcacgtcttatggatgtttccgatcttgaccaaacaatgggtggacttcctgacaagggaaacctgcccttgcttaaggtttgggggcccgggggaaactggtttaacgggggggaattcccaaaaaaccttccccccgggggaaaaacccccacccttttccggggattttgggagaaaaaacccttgtgttatccccaaaaataccattttgtgggggggggccggggaaaaaaaaaagggggggggcagggtccctcttttgaggggggaaaaaaaaaattctaaaaaaaagggggggcggaaaaatttttttggtaaaaaaaaagggggggtttttttttgggaaaaatctcccccccaaaaaaaaaaaaacccccccccacaag

SEQ ID NO: 34497 - DNA, 800 bp, Zea mays
  misc_feature: Ceres CLONE 1413082-F
  misc_feature (1)..(1): n is a, c, t, g, unknown, or other
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
nccccccccccccccccccccctnntnnntnnnntgtccaccnnacaaagctggagctccaccgcggtggcggccgctctagaactagtggatcccccgggctgcaggaattcgcacgagaccattacctagaacatcctaatcaaaaacaacagaacaacctacccccacaagcagaaggatccgggcggccaccgagagtcattggaagaagctcgtccggcgccccgcgacgaagacgacggcctcctcctccgctccgctgaagaacgacctccccgctgacagaggcggagcgctccgcagaggcgcagagagaggtggcgtctgccttgctgcgctgcggttctggcggctcctgcagattcccgcacccacaagggcaggaggcgacccaccagcggccacccaaaaaaggcgcaccccttttcggccgcccaaatcttccttttaccccgatcccccaagccgcggccggctgctccctccgtacgcacgtaacgccccggggtcgcccttttatcttgttccccgggggcccgttggtccggcttgctgaaatcctcccccgttgttggctggggactgcagcggttgggggggccctttgaaaccaagaaagggtgtggccgaaggcccccccgcaattggttcggggggataaacctttcggggggaaacagattcccttcccaataaggtggcaaaaaaaggcccgttctcgattaaccggaaaaactcttgggtgggggagggccccaagggggcaccccacaaagggccccccattttggtctggg

SEQ ID NO: 34498 - DNA, 628 bp, Zea mays
  misc_feature: Ceres CLONE 1413083-F
  misc_feature: Encodes the peptide sequence at SEQ ID NO. 34499
  misc_feature (353)..(353): n is a, c, t, g, unknown, or other
  misc_feature (354)..(354): n is a, c, t, g, unknown, or other
  misc_feature (388)..(388): n is a, c, t, g, unknown, or other
  misc_feature (395)..(395): n is a, c, t, g, unknown, or other
  misc_feature (430)..(430): n is a, c, t, g, unknown, or other
  misc_feature (505)..(505): n is a, c, t, g, unknown, or other
  misc_feature (518)..(518): n is a, c, t, g, unknown, or other
  misc_feature (562)..(562): n is a, c, t, g, unknown, or other
  misc_feature (628)..(628): n is a, c, t, g, unknown, or other
aagctggagctccccgcggtggcggccgctctagaactagtggatcccccgggctgcaggaattcgcacgagaccattacctagaacatcctaatcaaaaaaattgcgacgccgccgccgtcactgtcgccgcaggagtgcgaaccacgctgccgcccgctcccgccgcccaaacagctttatccgagccccgattcgccggatcacatgctgcggccacctctcaaatgacctctcaactccagagcactttgctcctgctcccgctcttcgccgccgctgctttgggccgcggcggcgacgcctcgactgcgccgtcgctggagttccacatcggttctccgcaccgctgnncgcgtggtggaggcccaaggcgcgcgctcctggncggtggncgcttcccgcagcgcgcgtacgtcgccgccttgcngggacgatcgcaccgggggcgtgtcgcagccaggggtaataacagcgacgcaccaccgctcactttcggcgaggnaaatgccaccctncaggtcagcaacctcggatttttgcactatgctcttgtgaccgntggcaccaccgggccagacgttcatgggtgccgctggaaacaagcagcgatctctttttgggtgcn

SEQ ID NO: 34499 - protein, 133 aa, Zea mays
  misc_feature: Ceres CLONE 1413083-F
  misc_feature (42)..(42): Xaa is any aa, unknown, or other
  misc_feature (43)..(43): Xaa is any aa, unknown, or other
  misc_feature (54)..(54): Xaa is any aa, unknown, or other
  misc_feature (68)..(68): Xaa is any aa, unknown, or other
  misc_feature (93)..(93): Xaa is any aa, unknown, or other
  misc_feature (112)..(112): Xaa is any aa, unknown, or other
MTSQLQSTLLLLPLFAAAALGRGGDASTAPSLEFHIGSPHRXXRGGGPRRALLXGGRFPQRAYVAALXGRSHRGRVAARGNNSDAPPLTFGEXNATLQVSNLGFLHYALVTXGTTGPDVHGCRWKQAAISFWV

SEQ ID NO: 34500 - DNA, 634 bp, Zea mays
  misc_feature: Ceres CLONE 1413084-F
  misc_feature (265)..(265): n is a, c, t, g, unknown, or other
  misc_feature (266)..(266): n is a, c, t, g, unknown, or other
  misc_feature (268)..(268): n is a, c, t, g, unknown, or other
  misc_feature (271)..(271): n is a, c, t, g, unknown, or other
tccccgcggtggcggccgctctagaactagtggatcccccgggctgcaggaattcgcacgagaccattacctagaacatcctaatcgaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtgggtgtgaaaggnnanaantttaagatctgttccacagatcacgcgtgccgctcgcgaatcgggggttccacacatagcttcgtcgttttgaatttgatgtactaatggagtctaaggttggcaagaagtctagcagtagtcgttccatgatgtatgaagctccccttggctacagcattgaagacgttcgacctccggaggcgcgaagaagttcccggctgctgcttaactccactgcgccaagaaccatcctgatatcccttttggcttcctcggtctagaagttaaagatttctttttctgaaacttcgattcttaaccatcccccctggcctgctgcttttctgaaaatcgacaagttcccccagtcttggtccctgg

SEQ ID NO: 34501 - DNA, 671 bp, Zea mays
  misc_feature: Ceres CLONE 1413090-F
  misc_feature: Encodes the peptide sequence at SEQ ID NO. 34502
  misc_feature (358)..(358): n is a, c, t, g, unknown, or other
  misc_feature (361)..(361): n is a, c, t, g, unknown, or other
  misc_feature (364)..(364): n is a, c, t, g, unknown, or other
  misc_feature (367)..(367): n is a, c, t, g, unknown, or other
aagctggagctccccgcggtggcggccgctctagaactagtggatcccccgggctgcaggaattcgcacgagaccattacctagaacatcctaatcgaaaaaagatgaatgctacgtaggtagacagtgttcttgtggtgacgtgacctccacagagtgcagagatgggagaagctgaagaagcgccaggagacagcaatggtgaggcactggagctcctcatgtccatggcgtcctcttcgctggcctgcttctgtctcgcagttcccagccaagtggcagtccatcaaggacaagctccagctgctctgctgcagcctcaattcactctgcggcggcggcggtgaccacgacgacnacnacnacnaggagcatcctgtgttggctgagcttctgcggctggcttcagcaaccgtgaggagcatccaggtcgttgcttctcagtgcagcgacgggtcatacaaagggtggaagggcttcgtctgaggagcgacctggacaacctgagctgcaagctcgatgcgcacatgaaccagctcaaggaaatggccgtctcttccgggggcgccgtcgccgtccaagggcattggtcccccgtcaggcccagcgccaaggccagcgtgggttaaaaggccctcttacctcagggatttcttttccaggaatcagga

SEQ ID NO: 34502 - protein, 95 aa, Zea mays
  misc_feature: Ceres CLONE 1413090-F
  misc_feature (54)..(54): Xaa is any aa, unknown, or other
  misc_feature (55)..(55): Xaa is any aa, unknown, or other
  misc_feature (56)..(56): Xaa is any aa, unknown, or other
  misc_feature (57)..(57): Xaa is any aa, unknown, or other
MVRHWSSSCPWRPLRWPASVSQFPAKWQSIKDKLQLLCCSLNSLCGGGGDHDDXXXXEHPVLAELLRLASATVRSIQVVASQCSDGSYKGWKGFV

SEQ ID NO: 34503 - DNA, 806 bp, Zea mays
  misc_feature: Ceres CLONE 1413094-F
  misc_feature: Encodes the peptide sequence at SEQ ID NO. 34504
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnnnnnnnnnnnnnnnnnnnnnnnnnnggcgccggggcgggggcggggnnnccaaaactttttcaaagctggtactccccgcggtggcggccgctctagaatagtggatcccccgggctgcaggaattcgcacgagaccattacctagaacatcctaatcgaaaaaaggaaaaaaaaggatggctctccggcgcaacgccggatccctcgcgctccgcgccgccgcctacctccgccgccaccgtccccatcctcctcccccactggccctcgccgcccccgctcccactcccatacgctccccgctggccccgcctttccggcacttcgctgctccgcctggtactcagaccattaggaagcgaggcaaggaggaggacgatgccagtgcgggccccgcgaatgaacaacgccatcgccgctcccctacgtcaggctccgtcatggatgaaaggccacaacattcctcccccgggcatgaaaccctggcaggtttggcgatccaggatggaaaatggaaccttggttcgaggccgcaaaaggaaaaaccaaccccccccggtaagtgcaaaaccatggggttttttcccggaggcaaaaagttttaaacatgggaaccccaggggagaaaaaaacccctttgaaaaacccacagcccggggaaatagggctcaaaggggggggggggaaaaaaaaaagaaaaacggcgcgcattttaggggcggaggaacccgggaccttacaaagcatctggggggggcgccaaagggaaaaaagggggctatacaccgagataattatggggg

SEQ ID NO: 34504 - protein, 142 aa, Zea mays
  misc_feature: Ceres CLONE 1413094-F
MALRRNAGSLALRAAAYLRRHRPHPPPPLALAAPAPTPIRSPLAPPFRHFAAPPGTQTIRKRGKEEDDASAGPANEQRHRRSPTSGSVMDERPQHSSPGHETLAGLAIQDGKWNLGSRPQKEKPTPPGKCKTMGFFPGGKKF

SEQ ID NO: 34505 - DNA, 710 bp, Zea mays
  misc_feature: Ceres CLONE 1413095-F
  misc_feature: Encodes the peptide sequence at SEQ ID NO. 34506
  misc_feature (225)..(225): n is a, c, t, g, unknown, or other
gctcttgaactagtggatcccccgggctgcaggaattcgcacgagaccattacctagaacatcctaatcgaaaacaatccccgccttcctcggttccctcaccgcgaaccctaaccctagtccaccccgctcccatggacgaggatgctggcggcgcctcgccgccgccggtgccactggctcacgtgccccctcttcagcaccccaccaccgccgccccctcgnatcgggacatggcggcgtccccccacagctcgcgctccgtgacggagacggtgaacggctccccacgcttcgtgatccagggctactcccctcgccaagggcatgggcggtggggaagcacattcgccagggagaccttctccggtgggcggaaaacaagtggggggttctactttttacccccgacggaaagaacccccgagggaccacttccgttaaccgtctccggtctccatcgcccctcgttttcggatggcacccgacgtggcggccccccctccaagctccacgccccttgaatcagaaggggaaaggggaaagcacaagggccccctccccacttttgaccgctccaagggaggccggggcccgaacccccttaaagaaccggggaatcccttggggggggtaacaaaaacattcttttcggcgaaactggcccttggaaattatcaaaaatatccccaaaaatagattggcctagg

SEQ ID NO: 34506 - protein, 129 aa, Zea mays
  misc_feature: Ceres CLONE 1413095-F
  misc_feature (31)..(31): Xaa is any aa, unknown, or other
MDEDAGGASPPPVPLAHVPPLQHPTTAAPSXRDMAASPHSSRSVTETVNGSPRFVIQGYSPRQGHGRWGSTFARETFSGGRKTSGGFYFLPPTERTPEGPLPLTVSGLHRPSFSDGTRRGGPPSKLHAP

SEQ ID NO: 34507 - DNA, 894 bp, Zea mays
  misc_feature: Ceres CLONE 1413096-F
  misc_feature: Encodes the peptide sequence at SEQ ID NO. 34508
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (35)..(35): n is a, c, t, g, unknown, or other
  misc_feature (36)..(36): n is a, c, t, g, unknown, or other
nnncccccccnnnnnnnnnnnnacnccgccccccnncctccctccctacatcatagctgggactccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggggttcttcgccgctgtgctcctcgtcgtcgtccccgacgccggggtgacgagccagtaccggcggaagctgcaagcgacggggggaaatgccactggaacgccgaacgcgttcggcgtccccgccggggtaccatggcccccgcagcagggtgcacattcacgcttggggtgaccagggaggggcaccggacgaatgatcccggggccggtgggtgggaccggcccaatggggggctggggcaaggcagccacccctttcatggtaaccgggggaggggcgtcccccccgggaaccccggaaaagaaaaactggacagcttctcccggcgcggtggggggggaatccccaacaacgcgggctttacggacactacctttccaaacttacacccgctcgcgggggttttctttcccgaccaacttgggcaccccctccaacagacaccctctcaaggcatttagcctcccccaatgtacccatcccttcgtcccgccgggggtgggtccgcggcgccccaccgcggggggagggggtcttttttgccttctccccacgaccaccccccaggtgccgggtgcccctggaacctcgccccctctcaaggttccgggcttccatgtgg

SEQ ID NO: 34508 - protein, 73 aa, Zea mays
  misc_feature: Ceres CLONE 1413096-F
MSNMLRARRRLDLLQVGFFAAVLLVVVPDAGVTSQYRRKLQATGGNATGTPNAFGVPAGVPWPPQQGAHSRLG

SEQ ID NO: 34509 - DNA, 655 bp, Zea mays
  misc_feature: Ceres CLONE 1413097-F
  misc_feature (655)..(655): n is a, c, t, g, unknown, or other
cgctctagaactagtggatcccccgggctgcaggaattcgcacgagaccattacctagaacatcctaatcgaaaaggggcagagctggcaagtggcaaggctgcgcagccgcagagggactttttgtgtaaaatgcggtgggaaggtgcgctgcacctgcaagcagaggtgtgctctactgacagagtttgaactctcaagaggaggcgaggcagaaccgcaatcgcgaccgcgacccgcaggtgacatacatacggtgcgagcgccggaagccggaagcaccggtgacgaagccttccgtgtcatcactcatcaggatcttcaggggttttgttttcgtttcgccgggcgttgggaatccatccatggccgaggaagatgctctccgaccggggagggtggcggcccgccgccggatggttggccactaatgactacggatctcttcgtccatcgaggcggggcaagcggacaggcgttccgcgaattttaaaaccggcggcctccttcaaggggtaagggttgccaaatttgggagctcccattccgcccccgtcaaaaatcggagtggggtaagaaaaaaatgggggggacttggaaacaaaacgtgggcttcggtacctgaaaaaaaaccgcggggtaatgggacgacaan

SEQ ID NO: 34510 - DNA, 644 bp, Zea mays
  misc_feature: Ceres CLONE 1413102-F
  misc_feature: Encodes the peptide sequence at SEQ ID NO. 34511
  misc_feature (460)..(460): n is a, c, t, g, unknown, or other
  misc_feature (527)..(527): n is a, c, t, g, unknown, or other
  misc_feature (530)..(530): n is a, c, t, g, unknown, or other
  misc_feature (533)..(533): n is a, c, t, g, unknown, or other
  misc_feature (563)..(563): n is a, c, t, g, unknown, or other
  misc_feature (597)..(597): n is a, c, t, g, unknown, or other
  misc_feature (642)..(642): n is a, c, t, g, unknown, or other
  misc_feature (644)..(644): n is a, c, t, g, unknown, or other
aagctggagctccccgcggtggcggccgctctagaactagtggatcccccgggctgcaggaattcgcacgagaccattacctagaacatcctaatcaaaaactattatcccaaaaccacaacacaagaacgggaagcgtgcatgcacacgcacgagcacgaacctgagctgtagcgccctctcgctcgctccccgcgcgcaatggccagcgtagccccaggtcccatgcaaaccagccatgcctcacggcggccgatccctacagctacaggccccgtgcccgtggccgtgcttctcgccgccgccgccgtcggcctcctcgcgctgctgccgtcgctggccgaggccgtgtgggaggtgccgcacctcttcctcctcggcgccgtcatctccttcggcgtcttcacgcagaggaacagcgacgccgacggccgcgccaaggacagctcacaggcgtggnagcgcggtgtgccaccccgatgcccccctcgtcgtgatcgcggatcacacggcgccgagcgacgacnacnacnacgacgactacgggctggaactggaagaangcgcacgagagacgccgctttttcgtgccggtgncgaggctgatgaaaacctgcgtctgcgtctgcgtctgcgtttgtngn

SEQ ID NO: 34511 - protein, 134 aa, Zea mays
  misc_feature: Ceres CLONE 1413102-F
  misc_feature (87)..(87): Xaa is any aa, unknown, or other
  misc_feature (109)..(109): Xaa is any aa, unknown, or other
  misc_feature (110)..(110): Xaa is any aa, unknown, or other
  misc_feature (111)..(111): Xaa is any aa, unknown, or other
  misc_feature (121)..(121): Xaa is any aa, unknown, or other
  misc_feature (132)..(132): Xaa is any aa, unknown, or other
MASVAPGPMQTSHASRRPIPTATGPVPVAVLLAAAAVGLLALLPSLAEAVWEVPHLFLLGAVISFGVFTQRNSDADGRAKDSSQAWXRGVPPRCPPRRDRGSHGAERRXXXRRLRAGTGRXRTRDAAFSCRXRG

SEQ ID NO: 34512 - DNA, 860 bp, Zea mays
  misc_feature: Ceres CLONE 1413103-F
  misc_feature (19)..(19): n is a, c, t, g, unknown, or other
  misc_feature (20)..(20): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (237)..(237): n is a, c, t, g, unknown, or other
tttcccccccccccccccnnttatataacactagttnnttttaattnnatcaagctggagctccccgcggtggcggccgctctagactagtggatcccccgggctgcaggaattcgcacgagaccattacctagaacatcctaatcgaaaaatcccttgtcctgtcctcgaaccgtccgccgccgcgttcaacatgggcgacccgccgacgctcaagaggcccaagctcgagaaggncgacgacgactccacctactgcccccgcccgtcctccaatggcgccgcgcccgtacgcacaccaggcgccaccgccgccatagggggcggcgccggttgacgacgtggaaggaggaggatgacatcgccggaggaggcgttcattcgccctgaatccgcaccggggagcgcgacggccaagcgctgcaaagctcaagtttgctcccactacccagtcctctcctgggaacaccggcggaaaatgaaagcctggaaggaagggcccacctccgagggcttccccaggggtttcccaaagttccgcaaagcccgcccccccccaaacttcggggccggggaacccccaagggcccacccggacccccccgccccaatttcccaaaaggggaaacaccaaaagcctattcccccctgcccggccggaattcccaaagaggggtattcttcaaagcccaattccgcgcgccaacccccctttaaatcccaaagaagggtttttcttttctctccccggcgacccgcaaaagccggttcgggaccaaaggcccccgcaagactttgtgcctatccccttggggggaaccaaagataacccgggacccgaaccccccgatggccctgtg

SEQ ID NO: 34513 - DNA, 681 bp, Zea mays
  misc_feature: Ceres CLONE 1413104-F
  misc_feature: Encodes the peptide sequence at SEQ ID NO. 34514
  misc_feature (245)..(245): n is a, c, t, g, unknown, or other
  misc_feature (394)..(394): n is a, c, t, g, unknown, or other
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaaaagtctggccaggtctctcccatatcgggttctcccttcctcttcctgtttccgcgcgcgagatcgccgccccgggtgggctctagatcccgatggcctcgcgccgccgcaccctgctcaagtcatcatcctcggcgacagcngggttgggaagacgtctttgatgaaccaatatgtgaacaagaagttcagcaaccagtacaaggctacgattggggcggatttcctcaccaagggagtgcagttcgaggacaggctcttcactctgcaaatatgggacactgctggtcanngaaggttcagagtcttggcgttgcattctaccgggagcagattggtgtgcctagtctatgatggtaattctatgaaatcgtttgataatcttcacactggggtgaagagtttctaatccaggcgagcccatcagatcctgaacattttcccttttggtctgttggggaaacaaagttgatggaaaatggggggaacagccggggtggtgtcggaaaaaaagcaaaaggctgggggcgccttctaagggaacatcccgtacttttgaaacgccggctaagaatggaa

SEQ ID NO: 34514 - protein, 81 aa, Zea mays
  misc_feature: Ceres CLONE 1413104-F
  misc_feature (1)..(82): Pfam Name: Ras Pfam Description: Ras family
  misc_feature (43)..(43): Xaa is any aa, unknown, or other
  misc_feature (44)..(44): Xaa is any aa, unknown, or other
MNQYVNKKFSNQYKATIGADFLTKGVQFEDRLFTLQIWDTAGXXRFRVLALHSTGSRLVCLVYDGNSMKSFDNLHTGVKSF

SEQ ID NO: 34515 - DNA, 673 bp, Zea mays
  misc_feature: Ceres CLONE 1413109-F
  misc_feature (318)..(318): n is a, c, t, g, unknown, or other
  misc_feature (332)..(332): n is a, c, t, g, unknown, or other
  misc_feature (409)..(409): n is a, c, t, g, unknown, or other
  misc_feature (410)..(410): n is a, c, t, g, unknown, or other
  misc_feature (480)..(480): n is a, c, t, g, unknown, or other
ggagctccccgcggtggcggccgctctagaactagtggatcccccgggctgcaggaattcgcacgagaccattacctagaacatcctaatcgaaaaacaaatcaaatgattccttgcttgcccccctttccctccaaaattctcgctgcggccctcgtcttcctcctcttcttcttctgtaaagtgccaagtgccaactgcattctggcttacttggaacaccactccttgattccttcccattccaccagtctcatcttgcatagtgctagaacttatccatttgcttgctactgctcttgcccagcatgagcaaancggcgatgatgacnacgcccgcgggcggaaaaagacggtgagccatccagggcgctcccggggaaacccgggggcccccccccccctcaanncggggggggaaacggccgcaacccaaaaaaggaaaagggcccggaaccgggaaccatggccccccaaggngaacggccccaaaaattttgtggaccaaattggaaagccgctttttaaaaggggggaaaaaacccccaaccaaagaggggtatcaggggccccgggaaaatggtcccccccccaaaaaggggaaaacaaacccccccaagccgaaacaaaaaccctttttgtgccaaaaaaaacacaaaaaccccccaatttg

SEQ ID NO: 34516 - DNA, 826 bp, Zea mays
  misc_feature: Ceres CLONE 1413110-F
  misc_feature: Encodes the peptide sequence at SEQ ID NO. 34517
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (64)..(64): n is a, c, t, g, unknown, or other
  misc_feature (76)..(76): n is a, c, t, g, unknown, or other
nnnnnnnnnnnnnnnnnnnnnnnnnnnnnnnnnnnnnnnnnnggcccgggcccggganngnggngccccctttttntcaaagctggagctccccgcggtggcggccgctctagaactagtggatcccccgggctgcaggaattcgcacgagaccattacctagaacatcctaatcgaaaatggctgtttctgggagtgggcagcaacatggcagtgtttattggaagaagggcagccatgctgtgttatcctccttggatgctagtaaaagcttgttatctcaactcaaggatgcattttctacaatgaactcaccattatggatggatagtagcacaacaaagcaatgcagagaaatagagaatgcagttggaggtgcactggagttagcaaaactgacaggatctcgtgcgtatgaaagattcactggcccccaagataaggaagatctatcagacagcggcttgatgttttatgaaaaataccgaaagaatatcctttggggggacctccgttcatggcaatctaatcccttggttggaaaccttttgcaaggaatttggtggaaacttggatggggggccggggaatgaaaccttgaagggaaaacccagcgcaaagggaccccgggccaaaaatctcgctttttaaagggccaccccccccccccggcctttcaaaacccaaaactttgggaaaatctggcccaccccaataatccactattggggtgccccatattccctccctttttttcgtaaaaacagggttcttcctccttttaaaaaaacaatgttgtttgccccctctcccgcaacacaccgca

SEQ ID NO: 34517 - protein, 137 aa, Zea mays
  misc_feature: Ceres CLONE 1413110-F
  misc_feature: SWISSPROT Homolog: EC 2.7.1.17 Xylulokinase
MAVSGSGQQHGSVYWKKGSHAVLSSLDASKSLLSQLKDAFSTMNSPLWMDSSTTKQCREIENAVGGALELAKLTGSRAYERFTGPQDKEDLSDSGLMFYEKYRKNILWGDLRSWQSNPLVGNLLQGIWWKLGWGAGE

SEQ ID NO: 34518 - DNA, 672 bp, Zea mays
  misc_feature: Ceres CLONE 1413111-F
tccccgcggtggcggccgctctagaactagtggatcccccgggctgcaggaattcgcacgagaccattacctagaacatcctaatcgaaaaacctctcgctacatcttttactggcgctcttttcttcctttctttgtaccagcgcgcggggtgttcgttcggtcgcacgagagatcgatcctccgctcggtcatcgtgcgagggctcgcacaccttctgcttgccctgcatcatagtgcacccgcgctcgtcctccgcgaacggggatgtggcctggcccgtctgctcctcgcgggggcgccagcggctgttcctcttcttgctccgcctccactgctccttccaggaccacgagtaccgcataacgagtcaaccacggcgtgtacctggccaccatccccgtcatcgtgctggtgtgcggcgtccagttgcgcagcctcagccgcgacgagctgtgctgcaaggtgtgcgggtaggcccactacgaccctcacactgtgcaccccttcctcgccgacacccactttctggtctccgcctacatcatggtccagcccaataaacgcgctatacatcgaccatacaaccaccaaaccgacccgcaacaacaacattgggccacaaaacattgagaatacacggaagacaaaccaaacctacatccccatcga

SEQ ID NO: 34519 - DNA, 785 bp, Zea mays
  misc_feature: Ceres CLONE 1413113-F
  misc_feature (20)..(20): n is a, c, t, g, unknown, or other
  misc_feature (46)..(46): n is a, c, t, g, unknown, or other
tttttttttttttttttttnccggattttgtcccttcccgcaccangacccaaccccgaaccaaagttggagctccccgcggtggcggccgctctagaatagtggatcccccgggctgcaggaattcgcacgagaccattacctaaacatcctaatcgaaaaaccaacccttgtagtctcagtcaatctgtagattgagactacgatgagcctgtcaccgctcgactcctctacccgccggccgcggctgcggctgctgcttaccggaaggtgcccctttcccggtggagagcaagccggccgggcacacccaagaaaaggggggcaaaaaacaaacaaaagcaggccggttgaccggcatcgccgccgctccgtagttgcccctaaaaaaccaccttatttgttagttgggtaaacaccaggctcccgaaatcactcccacgtcaatccacacaaaccgtatatgaagtgaaaactacccgcccgcctcactccccaccggggcgccccaatagcccgcgtcgccgccctcaccccacgggcgcaacctaggagaaacccatgggggggggggggggcgtcaccctcatgaacggcgtccaacaaagggcgaaaatatgggcccggggaagagacaagtgtgtattgaattatatatgatagtaaaaaagagaattgaagacgctttatacacctctcaccaatccacgggaacaaccccttataacccctcgcccgggactattggaacgggggcgagcattccgcgagcgaggcggtacggg

SEQ ID NO: 34520 - DNA, 617 bp, Zea mays
  misc_feature: Ceres CLONE 1413117-F
  misc_feature: Encodes the peptide sequence at SEQ ID NO. 34521
  misc_feature (429)..(429): n is a, c, t, g, unknown, or other
  misc_feature (442)..(442): n is a, c, t, g, unknown, or other
gctctagaactagtggatcccccgggctgcaggaattcgcacgagaccattacctagaacatcctaatcaaaaaaggtcgagcctagggttagggtttcgtccctccggccccgattcgaaccaatccgcctcggcctccgccgcgccatggccgccggctccatcgtggtggacttcccttccatgggcgccgccctctgcttcccagcctcgatcactcctccgcgactccgcctcgggcttcctcgctgccgtctccaacgcccagcccccggcgcagccgacctcaccaactttcaccgcgtcttctcgcgcgtcctcagcgcctacccggaccaccgctcggagctgtctgtttctctccggggtctcctccacgaccgtcccgacgactccgctccctggtccagttctctcggcttcaacgncttctcgcccggnaccgccaagccgcttgccctctcgcccctgtcgtttccgagctcttcacgccaacaagccgggaggaagaccgaaaccctcggtgagggcggcctcagctacataagaatttgaagaacgtctgcccctctcacgtgcgcacgcaacctgacctgtgcgcttggactccagggac

SEQ ID NO: 34521 - protein, 135 aa, Zea mays
  misc_feature: Ceres CLONE 1413117-F
  misc_feature (94)..(94): Xaa is any aa, unknown, or other
MAAGSIVVDFPSMGAALCFPASITPPRLRLGLPRCRLQRPAPGAADLTNFHRVFSRVLSAYPDHRSELSVSLRGLLHDRPDDSAPWSSSLGFNXFSPGTAKPLALSPLSFPSSSRQQAGRKTETLGEGGLSYIRI

SEQ ID NO: 34522 - DNA, 892 bp, Zea mays
  misc_feature: Ceres CLONE 1413123-F
  misc_feature: Encodes the peptide sequence at SEQ ID NO. 34523
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
aaacccccccccnnnnaaannnacaaaaacaaagaggttcatggaaaacaaagctggagctccccgcggtggcggccgctctagaatagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgtcaagttggtatgtcagggatcacagcattttggcgtccggcatggccattagctgctagtcagattctaatggaaacatattttggcccctctgaatcctctggtggttctgaaggtgggtccaggcagggggactaaagccttcaagaaaacctgaaattttcctggtggctaaaccaaatccaggggggggggggatttggcattcctggccttccgccaagcaaaataatggggggccacccggcccaaaaagggttgggccccccttttcctgggcccggaaagggaacacacaaaaagtgggcggggaattcacccttccaaaaaggcccccagacacaagggggggcatatttgccccgggaatttttttggagggggggtggccgaaggttttctattgggcggagacaaccctccccaacaaacgcgcgggaaaacccgagcccagaaaacacttccccgagggaagggggggcccccccaaaatccccccctctcaacaaaaagaagatctctaagggggtccgaccccccgcaggcgcggtgcgggggggggaccccccggggacgggagaacctccgg

SEQ ID NO: 34523 - protein, 30 aa, Zea mays
  misc_feature: Ceres CLONE 1413123-F
MENKAGAPRGGGRSRIVDPPGCRNSHETIT

SEQ ID NO: 34524 - DNA, 615 bp, Zea mays
  misc_feature: Ceres CLONE 1413125-F
  misc_feature (307)..(307): n is a, c, t, g, unknown, or other
  misc_feature (460)..(460): n is a, c, t, g, unknown, or other
  misc_feature (461)..(461): n is a, c, t, g, unknown, or other
  misc_feature (487)..(487): n is a, c, t, g, unknown, or other
aagctggagctccccgcggtggcggccgctctagaactagtggatcccccgggctgcaggaattcgcacgagaccattacctagaacatcctaatcgaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaagtagattgcatttgtggatgctctaatggagtcgaaaggtggcaagaangtctagtagtagtagtagtaattttcatggtacgaagcttccccctggggtaaccaaaaatttgggggggggttttcccccccccccccccggggggaaaaaaaaaaaaacccccccccgcggggggtgtttttttttaacacgtgggggggnnccccccccccccccccccccggtagnccccccccccccccccccatttttggggggggggggggaaaaaaaaaaaaaaaaaaaaattcttcttcttcccccccgggggggggggggggggaaaaaagaggggtgggggggggggggcggcgcct

SEQ ID NO: 34525 - DNA, 679 bp, Zea mays
  misc_feature: Ceres CLONE 1413127-F
  misc_feature: Encodes the peptide sequence at SEQ ID NO. 34526
gctctagaactagtggatcccccgggctgcaggaattcgcacgagaccattacctagaacatcctaatcaaaaaattccaatcaatcggaccgacaccggctaaccctagcttctgtttggctgttgccttgcgggtggcggctgctttggtgcgctgcgcagtgcgctccgtccgtccgtcgacccggaagggcggcccctgcccctgctcgtcgtcttcctcgggcgctcgtcttcctccgaacgcgcgcgggccgccgacctgcttgttctcctggaggagcgcgcccggcgggcaagcgacgcaatccagcggcgggttgaggaaaaaagcgagcgaccggtggatcccggtccagccgtcccctgctcctcttcctcgggtcgggcgctcgtcatccactcttcctccaggcctccatctgatccccgtacgaccgccccctgctcgccttcctggtgctcggctggtccagtggtcggcccctactggagggctgctcggtcgcgtccgcacctgttggaaatctggtcgacctcggttgctcggttccctgggaaacctggtttcctggtgaaagggtgaattctagaagtctgcttgcgtaacctttaataagaatcaggggggaccaacttttaagtagcaacctaaccaaaataaactttaaaaaagaa

SEQ ID NO: 34526 - protein, 33 aa, Zea mays
  misc_feature: Ceres CLONE 1413127-F
SRTSGSPGLQEFARDHYLEHPNQKIPINRTDTG

SEQ ID NO: 34527 - DNA, 704 bp, Zea mays
  misc_feature: Ceres CLONE 1413130-F
  misc_feature: Encodes the peptide sequence at SEQ ID NO. 34528
  misc_feature (281)..(281): n is a, c, t, g, unknown, or other
  misc_feature (282)..(282): n is a, c, t, g, unknown, or other
  misc_feature (292)..(292): n is a, c, t, g, unknown, or other
  misc_feature (310)..(310): n is a, c, t, g, unknown, or other
  misc_feature (311)..(311): n is a, c, t, g, unknown, or other
  misc_feature (321)..(321): n is a, c, t, g, unknown, or other
tggagctccaccgcggtggcggccgctctagaactagtggatcccccgggctgcaggaattcgcacgagaccattacctagaacatcctaatcgaaaagcaaattgcgcgtctcctccgcccttaatcctgacaaaaggaaaaacgcgaagcagagctccctccctcctctctcctcttcttcttcgtcgtggtgttggtgtggggcatctcgcaccccacccatccctgtcctcccgctcgccggtgcgcgcgcttttctagggtttccgctgccccagnncgcaatcccngctcactctcgtcaccgnngatggcgtcngcgtcggtgtcggccccggtggcagggccaggggcccgggggcgggaaggaccaagaacctcgccgatctggtgcggggcctcatggacggccttcctcggtacggtgatcggctgcccttcaccttgatcgcagaaacttcgttcactaactacacttgtgggaatctcgatcaacctttttgtttcccgggaaaatgttaaaagtcctccaaaaaaacctcgaggggcctcaaaggaaagttgcccccttttttttaaaaccccccccttaattgtcgggccaaggggttttaacccggaaaaaaggttttgtttcttcggaattttaaaggcccccggggggccccccccttttttccccccaaaaaaattcgacttttt

SEQ ID NO: 34528 - protein, 39 aa, Zea mays
  misc_feature: Ceres CLONE 1413130-F
MDGLPRYGDRLPFTLIAETSFTNYTCGNLDQPFCFPGKC

SEQ ID NO: 34529 - DNA, 698 bp, Zea mays
  misc_feature: Ceres CLONE 1413140-F
  misc_feature: Encodes the peptide sequence at SEQ ID NO. 34530
  misc_feature (257)..(257): n is a, c, t, g, unknown, or other
  misc_feature (283)..(283): n is a, c, t, g, unknown, or other
  misc_feature (286)..(286): n is a, c, t, g, unknown, or other
  misc_feature (289)..(289): n is a, c, t, g, unknown, or other
  misc_feature (343)..(343): n is a, c, t, g, unknown, or other
  misc_feature (410)..(410): n is a, c, t, g, unknown, or other
  misc_feature (414)..(414): n is a, c, t, g, unknown, or other
  misc_feature (446)..(446): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
aaactggagctccccgcggtggcggccgctctagaactagtggatcccccgggctgcaggaattcgcacgagaccattacctagaacatcctaatcgaaaactactagtgatcagaccagtgagctagcgactgtaccatgcagcagctgtaggagagcctggtggtaggtaggataggagtagcgccagccgccaagtgcgcgtcccggctggctgcttcgacgagcaggagggagccgcaccgccgggctcccgnaatgtcgcctcctccgcccccgccgntgntgngcaacgagctgtcgcgcaggacggcggtgctgggcctgcgcctgtgggtgctgntgggcatcgccgtcggggcccgcttcgtgctgctcctcgtgttcatctccctccacctcgccgcggngcgncggaagcggcccaggaagggcgtcgcgcacgngcacgcgcccgnnngcgggggggggcgccgccgttgtccccgttcaccatccccgcccgtggtccaggaagatccaggaggtggccgtcccacgtcgggttcccttccgcaactacctccaaaagggggcacgccgttcctcaaagaacggcgggggtgacggcaaaggggaacgttaatttccgtggcgcaagggttcccaaccgcgtccacattcaaggttggaaaggggccaccccatggtccccggcg

SEQ ID NO: 34530 - protein, 115 aa, Zea mays
  misc_feature: Ceres CLONE 1413140-F
  misc_feature (9)..(9): Xaa is any aa, unknown, or other
  misc_feature (10)..(10): Xaa is any aa, unknown, or other
  misc_feature (11)..(11): Xaa is any aa, unknown, or other
  misc_feature (29)..(29): Xaa is any aa, unknown, or other
  misc_feature (51)..(51): Xaa is any aa, unknown, or other
  misc_feature (63)..(63): Xaa is any aa, unknown, or other
  misc_feature (67)..(67): Xaa is any aa, unknown, or other
  misc_feature (68)..(68): Xaa is any aa, unknown, or other
MSPPPPPPXXXNELSRRTAVLGLRLWVLXGIAVGARFVLLLVFISLHLAAXRRKRPRKGVAHXHAPXXGGGRRRCPRSPSPPVVQEDPGGGRPTSGSLPQLPPKGGTPFLKERRG

SEQ ID NO: 34531 - DNA, 741 bp, Zea mays
  misc_feature: Ceres CLONE 1413141-F
  misc_feature (4)..(4): n is a, c, t, g, unknown, or other
gggntagaaaaaggggggagggggaggaaggggaattagaagaagcaccgactttaaaaagctggagctccccgcggtggcggccgctctagaatagtggatcccccgggctgcaggaattcgcacgagaccattacctagaacatcctaatcgaaaaaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcggccccgcgcgtccccgcccgcgtctaccaacggcgccgccaccgcgcttggaaccccccgtgtccgcctcctttgcccgtgacccgcgccgaggacctgcaggccgaggcccgcgcgatggcccgcgccgctggcgcccccccctaaagtcccgagatcctcgccgcccgatacaatcccgcccactaaagggggcgctccggccaggggaaggcactgcctcttttggccaacttcacataaaaagccaccacctaaaaccaccagaaaataaaatcgtctaaaaacaaaaaaaacaccgccggccacaaaaagcagacgtggcgcctcaggaggtggggggagaacgaacatggttagaaggaaatgctaagagat

SEQ ID NO: 34532 - DNA, 679 bp, Zea mays
  misc_feature: Ceres CLONE 1413142-F
  misc_feature: Encodes the peptide sequence at SEQ ID NO. 34533
  misc_feature (376)..(376): n is a, c, t, g, unknown, or other
  misc_feature (437)..(437): n is a, c, t, g, unknown, or other
  misc_feature (457)..(457): n is a, c, t, g, unknown, or other
  misc_feature (480)..(480): n is a, c, t, g, unknown, or other
  misc_feature (483)..(483): n is a, c, t, g, unknown, or other
  misc_feature (505)..(505): n is a, c, t, g, unknown, or other
  misc_feature (528)..(528): n is a, c, t, g, unknown, or other
  misc_feature (571)..(571): n is a, c, t, g, unknown, or other
  misc_feature (679)..(679): n is a, c, t, g, unknown, or other
tggagctccccgcggtggcggccgctctagaactagtggatcccccgggctgcaggaattcgcacgagaccattacctagaacatcctaatcgaaaaatcttttcctttcctatccctcgtctcgtctcgtcttcgttcccctttcctcctgcgcaccccgtcttctcctcaccgcgtcaaaccccagcacaaatcaaccgcccgccgcctccgctcccctcccgtcccgaatcagccgccgcggtgcccaatccggccgatcccccctcctatccgccgcagagtcggcgcctctgggcctaccccgatgtatagcaacttcaaggagcaggcgatcgagtacgtcaagcaggcggtccaggaggacaaatgccngcactacgtcaaggcgttccctctctacatgaacgcgctcgagtacttcaagacccatctncagtacgagaagaacccccnagatcagggagccatcaccgccnagntcaccgagtacctcccgcgcgnccgagagatccgggccgtcctcnacgagggcggcgcggggcccggggcccaacggaggtgacgcanccgtcgccacgcgccccaagacaaagggcaagggacgcgaacggggcaacggaagggatgactcccaagcagtccagctcagggcggggctcaactctgccataatcn

SEQ ID NO: 34533 - protein, 85 aa, Zea mays
  misc_feature: Ceres CLONE 1413142-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (23)..(23): Xaa is any aa, unknown, or other
  misc_feature (50)..(50): Xaa is any aa, unknown, or other
  misc_feature (58)..(58): Xaa is any aa, unknown, or other
  misc_feature (59)..(59): Xaa is any aa, unknown, or other
  misc_feature (66)..(66): Xaa is any aa, unknown, or other
  misc_feature (74)..(74): Xaa is any aa, unknown, or other
MYSNFKEQAIEYVKQAVQEDKCXHYVKAFPLYMNALEYFKTHLQYEKNPXDQGAITAXXTEYLPRXREIRAVLXEGGAGPGAQRR

SEQ ID NO: 34534 - DNA, 590 bp, Zea mays
  misc_feature: Ceres CLONE 1413146-F
  misc_feature (194)..(194): n is a, c, t, g, unknown, or other
  misc_feature (229)..(229): n is a, c, t, g, unknown, or other
  misc_feature (246)..(246): n is a, c, t, g, unknown, or other
  misc_feature (275)..(275): n is a, c, t, g, unknown, or other
  misc_feature (324)..(324): n is a, c, t, g, unknown, or other
  misc_feature (338)..(338): n is a, c, t, g, unknown, or other
  misc_feature (477)..(477): n is a, c, t, g, unknown, or other
tccccgcggtggcggccgctctagaactagtggatcccccgggctgcaggaattcgcacgagaccattacctagaacatcctaatcaaaaactcacctctcactaccaccaccactgccccggatccataccagctgcagcagcagcgcgcgcgagctagcttcggtcggtcgatagatcgatcgatcgctcgncatcatggcgcgggaggagcagcgctgctgtcgancgagatcggaaccgcgncgtggaagccgtcgggcccggacgccggntcgcggggctcttcggggggggtgcgcgcccgcctgccgaatttccggnggcggggaaccccnagaacgggggcctcgggtaccataacctcctgacccccgggggggaccgggacccctcccccggatttggggtgggggggggggcccaaaatttggaaacccccccccccccacaggtggggggaaaaggggggggggnaaagaacccaaaaaacccccccccgggggggtcccttttccctgggggggcctggcttataaatgttttggaaatatggtttccgcggcgccggaccccggggttttctcttc

SEQ ID NO: 34535 - DNA, 508 bp, Zea mays
  misc_feature: Ceres CLONE 1413150-F
  misc_feature: Encodes the peptide sequence at SEQ ID NO. 34536
  misc_feature (308)..(308): n is a, c, t, g, unknown, or other
gctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaacctaaccggccgacggtggccatgatggccaccgagcccttgtccccggggaatctcgtcgaggacgtcgaaacactacccctggactcctcctccactctcgcggntacgacggacccgctgctccgcccacctcccccctcgtccaccttctctcccaccgccggtgagaacccatggcgctttttctggaacaaggaggaaggaggacgtggtggaaatgaatttcccgccctcccctggggtcccccaatggcccctaacggcccggggacgaaagtcccccgggaaagggcagccacccgca

SEQ ID NO: 34536 - protein, 95 aa, Zea mays
  misc_feature: Ceres CLONE 1413150-F
  misc_feature (29)..(29): Xaa is any aa, unknown, or other
MMATEPLSPGNLVEDVETLPLDSSSTLAXTTDPLLRPPPPSSTFSPTAGENPWRFFWNKEEGGRGGNEFPALPWGPPMAPNGPGTKVPRERAATR

SEQ ID NO: 34537 - DNA, 696 bp, Zea mays
  misc_feature: Ceres CLONE 1413151-F
  misc_feature: Encodes the peptide sequence at SEQ ID NO. 34538
  misc_feature (696)..(696): n is a, c, t, g, unknown, or other
aaaagctggagctccccgcggtggcggccgctctagaactagtggatcccccgggctgcaggaattcgcacgagaccattacctagaacatcctaatcaaaaaacaagcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagccccttgaaatgaatgaaccatgcaggcgctgagcgagtctatacgtacgtcgtcaccggctggccacgcatgcn

SEQ ID NO: 34538 - protein, 149 aa, Zea mays; identical to SEQ ID NO: 12336
  misc_feature: Ceres CLONE 1413151-F

SEQ ID NO: 34539 - DNA, 684 bp, Zea mays
  misc_feature: Ceres CLONE 1413152-F
  misc_feature: Translation starting site: 159
  misc_feature: SWISSPROT Homolog: EC 1.2.1.3 Aldehyde dehydrogenase (NAD(+))
aagctggagctccccgcggtggcggccgctctagaactagtggatcccccgggctgcaggaattcgcacgagaccattacctagaacatcctaatcaaaaaatccgctccccgccttccgcttccctaccccccgcatcacctaccaacgccgacaccatgggggccttcgcgaatgaggagcaccagttcctcgccgagctcggcctcgcgcagcgcaacccgggcgcgttcgcatgcggtgcgtggggcggctcaggtcccaccgtcacctccacgagcccgaccaaacatcaggtcatcgcagaggtcgtggaggcgtccgtgcacgactacgaggagggcatgcgcgcctgcttcgacgccgctaagacatggatgccgattcctgctccaaagcgagagagatcgttaggcaaatcggtgatgcactgagagcaaagctccatcaccttggcaggcttgtggcacctgagatggggaaaaatctcctggagggatcggggagggtcaggaaatcattgaaatgggggattatgcttgggggaattagcccccaactaaatgggatcccttataccttctgaacgaccaaaccatattgtggggggggggggggaacccccctgggaggtggggggggtataacgggattttatttccccctggggtggggcttgggggg

SEQ ID NO: 34540 - DNA, 737 bp, Zea mays
  misc_feature: Ceres CLONE 1413153-F
  misc_feature: Encodes the peptide sequence at SEQ ID NO. 34541
  misc_feature (383)..(383): n is a, c, t, g, unknown, or other
  misc_feature (390)..(390): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (693)..(693): n is a, c, t, g, unknown, or other
  misc_feature (694)..(694): n is a, c, t, g, unknown, or other
tagagctggagctccccgcggtggcggccgctctttaccagaggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgncaagggncggcgccacgtgtcctacggcgcccaggtgtcggcgggtggccgacaaaggcccggctcaggaagatcccgggccgtcagggccaagaaaatgctgctggggggcaacccttcaggagattttgggtcgacgaccccgcccctggtaagtttccctggaagggcctcggggggccggtcccccaatttcccccggagagggctttcaagcccaagaaaccggccccccccgaacccggggggggttcccccggaacccggaggaaaaaaaaaaattttttaaaaaaannnnnnnnncnnnnannttttttttttccctggagaaaaagggggggggagatattcttg

SEQ ID NO: 34541 - protein, 165 aa, Zea mays
  misc_feature: Ceres CLONE 1413153-F
  misc_feature (2)..(132): Pfam Name: DUF538 Pfam Description: Protein of unknown function, DUF538
  misc_feature (70)..(70): Xaa is any aa, unknown, or other
MTLTIPDEVRAKAEVYVGDAAGQEKTRLLLQETGLPSGLLPLRDIIECGYVEETGFVWLRQRRKVDHYFXKGRRHVSYGAQVSAGGRQRPGSGRSRAVRAKKMLLGGNPSGDFGSTTPPLVSFPGRASGGRSPNFPRRGLSSPRNRPPPNPGGVPPEPGGKKKIF

SEQ ID NO: 34542 - DNA, 679 bp, Zea mays
  misc_feature: Ceres CLONE 1413164-F
  misc_feature (528)..(528): n is a, c, t, g, unknown, or other
aagctggagctccccgcggtggcggccgctctagaactagtggatcccccgggctgcaggaattcgcacgagaccattacctagaacatcctaatcgaaaaccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcggaaaggccggccagccgcccacaccccatccggccagccaggcggaaacgaccgtaagagggaagccgcagccggccgctgactccgatcccacctctagtcaaccccaggcagaccgatcctcttcgtctgaccacgacgtccatctcgcacgcctacttccactcaaccacataagtcttttctgccaggcctaacctttcccctgcgccgcctctactggttttgcacagtgccgtgacgtgggaagacgtgnagatccaacgaaaattagatttatttcttccttcttcgggccaacaggttcctcagcttgcgtaagatccgtctgggttgtccgccctccattggactacccaggtgcggcgcatccaccaggtggaaatatctgcgtaagtcaaacataa

SEQ ID NO: 34543 - DNA, 696 bp, Zea mays
  misc_feature: Ceres CLONE 1413165-F
  misc_feature (668)..(668): n is a, c, t, g, unknown, or other
aaagctggagctccccgcggtggcgagccgctctagaactagtggatcccccgggctgcaggaattcgcacgtgaccattacctagaacatcctaatcgaaaagccacaacatcacgaaaggaccggatcttggtgagctcgagggtacatgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcggtgcgcatttctcggctcgttcattcttgtgccctccttcgattacttcatttcgtcgcgtcccaaatcggtcgatggaaaatggaatctcgatggcttttgttaaatctggattgctatgcatgtctagcgatgcacttggatttttggtacagtgagattggtagccgcacatggggaatctcgatggcttttgttaaatctgaattgctatgcatgtctagcgatacacttggatttctggtaccgtgagattggtagttgcagatggatacagggggccttagtggagggggcacagaaagactgaatatgggggtggaaacatcttctcatctggacgttgaaacaatgccttcagttccctggggggngggcgggttattgctccttttggaccag

SEQ ID NO: 34544 - DNA, 685 bp, Zea mays
  misc_feature: Ceres CLONE 1413167-F
  misc_feature (361)..(361): n is a, c, t, g, unknown, or other
  misc_feature (362)..(362): n is a, c, t, g, unknown, or other
  misc_feature (435)..(435): n is a, c, t, g, unknown, or other
  misc_feature (436)..(436): n is a, c, t, g, unknown, or other
  misc_feature (630)..(630): n is a, c, t, g, unknown, or other
  misc_feature (631)..(631): n is a, c, t, g, unknown, or other
  misc_feature (652)..(652): n is a, c, t, g, unknown, or other
  misc_feature (685)..(685): n is a, c, t, g, unknown, or other
aagctggagctccccgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttggtggtggtgttcagcccccctccctcttcaggtttagggtggagcgatccgtgcaggccaacgcgnngtgcgtgacccagaaagggaaacccgccgcttttttctcttctgccgccccgcttttccaaatccctctcaannctcatcgccccgcccgcaccatcaccaaaaaggtccccgccttcttcttcctcttctcctctgcccctgcttgtcgtttgctcgtgctcccccaccccccttctgattcagccagggttccttccgcggcgcggcgcgtcgccatgggcaactgctggggcgccaagatcagctccgacagcccctcccggggnngctcctcccccgtaaggacgncgtccaagttgcgaagcagaaaacggggcgcgn

SEQ ID NO: 34545 - DNA, 692 bp, Zea mays
  misc_feature: Ceres CLONE 1413169-F
  misc_feature: Encodes the peptide sequence at SEQ ID NO. 34546
tggagctccccgcggtggcggccgctcttacctagtggatcccccgggctgcaggaattcgcacgagaccattacctagaacatcctaatcgaaaaacttccaccccggaccgacaaagcagagcacacgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacgggagcgccaacgacctctacgagtcggcgcagctctacctcagggcggggtgccttcgcaccgggcccggccgggggcctgcacaagccgcgccaggcccccccgccccgtgggggtcccttccggaatttcccaccccaccgaaagaaccctttcccggggggccccgcttcaaggggaaacttcccaccaccgggaaccctttaaacccgaagggggaagggggggggggggggggaaacccccaaaaaaaaatttttcgggccccggggggggggaaaaaagcgcggggccccttt

SEQ ID NO: 34546 - protein, 131 aa, Zea mays
  misc_feature: Ceres CLONE 1413169-F
MEMVLDWRSLGSLLATVVVFRTALRNFLPPEAEMLLRRFLAWVAAAFRPPSDTILIDEADGPTGAPTTSTSRRSSTSGRGAFAPGPAGGLHKPRQAPPPRGGPFRNFPPHRKNPFPGGPASRGNFPPPGTL

SEQ ID NO: 34547 - DNA, 695 bp, Zea mays
  misc_feature: Ceres CLONE 1413171-F
  misc_feature: Encodes the peptide sequence at SEQ ID NO. 34548
  misc_feature (293)..(293): n is a, c, t, g, unknown, or other
  misc_feature (451)..(451): n is a, c, t, g, unknown, or other
aagctggagctccccgcggtggcggccgctctagaactagtggatcccccgggctgcaggaattcgcacgagaccattagaacatcctaatcgaaaaacatcgatcactcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaggnaaaggatggagaagaagccgaccatcctcatgaacaggtacgagctcgggcgcacgctcgggcagggcaccttcgcccaggtgtacccacgccggaacctcgcgtccggcgagagcgtggccatcaaggtcatcgacaaggagaaggtgatgcgcgtncgcatgatcgaccagatcaagcgcgagatctccgtcatgcgcctcgtccgccacccccacgtcgtgcagctgcacgaggtgatggccagcaagagcagatatacttcgccatggagtacgtccggggcggcgagctcttcgcccgcgtcgccggcgggcggttcaaggaggacgccgcgagaggtacttccaccagcttcgtcggggcgtcgacttctgccacagccggggggtctaccaccgg

SEQ ID NO: 34548 - protein, 132 aa, Zea mays
  misc_feature: Ceres CLONE 1413171-F
  misc_feature: SWISSPROT Homolog: EC 2.7.11.1 Non-specific serine/threonine protein kinase
MEKKPTILMNRYELGRTLGQGTFAQVYPRRNLASGESVAIKVIDKEKVMRVRMIDQIKREISVMRLVRHPHVVQLHEVMASKSRYTSPWSTSGAASSSPASPAGGSRRTPREVLPPASSGRRLLPQPGGLPP

SEQ ID NO: 34549 - DNA, 769 bp, Zea mays
  misc_feature: Ceres CLONE 1413173-F
  misc_feature: Translation starting site: 294
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (17)..(17): n is a, c, t, g, unknown, or other
  misc_feature (18)..(18): n is a, c, t, g, unknown, or other
  misc_feature (24)..(24): n is a, c, t, g, unknown, or other
  misc_feature (26)..(26): n is a, c, t, g, unknown, or other
  misc_feature (34)..(34): n is a, c, t, g, unknown, or other
  misc_feature (45)..(45): n is a, c, t, g, unknown, or other
nnncccccccccccccnncccgcntngggggggntgttgtggaanccccagctggagctccccgcggtggcggccgctctagaactagtggatcccccgggctgcaggaattcgcacgagaccattacctagaacatcctaatcgaaaagaagacgcttcccgagcttctccttcgttcctcctcttccccgcggctctcctctgccccgcaccggcaccgctagggttttgccgccgacctctcgctcgcttccgggctccgcgaggcaaccgtccggaccggccggtcgaaatggtggatgtggaggaggtcgggaacaagatgcaatcgcagatgcgcctgcacgcggagccggatgacgccggcgccgacctccccctcccggcgctcttcgacagggcgtcccggcttcacgccctggcctccagctccggccctcgaccaggatgggatccgcaccgggggtgagctgctgcgggcgctgcgacgagatgggcggcaggctcgggcctttttctcccccaacgagaccaaggaggacgtctccaccgcaaacctcaaggcacctaactcggccccatattaccttggcggaaaatgaccggaaaaaatgggcgcaggaggaatcggaatcccgggttcttaaggggggcggagaaaccttttggaaggggttcattggctcctttgcgaaggcactaagggtttatttccagaggatggaggctagaaatgggccaagggcaaaaaacgggtgtggatactag

SEQ ID NO: 34550 - DNA, 776 bp, Zea mays
  misc_feature: Ceres CLONE 1413177-F
  misc_feature: Encodes the peptide sequence at SEQ ID NO. 34551
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (301)..(301): n is a, c, t, g, unknown, or other
  misc_feature (604)..(604): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (642)..(642): n is a, c, t, g, unknown, or other
  misc_feature (644)..(644): n is a, c, t, g, unknown, or other
  misc_feature (645)..(645): n is a, c, t, g, unknown, or other
  misc_feature (648)..(648): n is a, c, t, g, unknown, or other
  misc_feature (653)..(653): n is a, c, t, g, unknown, or other
  misc_feature (655)..(655): n is a, c, t, g, unknown, or other
  misc_feature (656)..(656): n is a, c, t, g, unknown, or other
  misc_feature (670)..(670): n is a, c, t, g, unknown, or other
  misc_feature (672)..(672): n is a, c, t, g, unknown, or other
gtgcccccccnnnnncccnnncacccgnanannntnntttccannnncccaaactggagctccccgcggtggcggccgctctagaactagtggatcccccgggctgcaggaattcgcacgagaccattacctagaacatcctaatcgaaaaacggaagggcccggacagttttgcgcacaagccccccattcccattctaccaccgacccgtcccgtcccactgcctgccagcgtctcccccgctccctctcctcgagagatctcgcgctccggcgatcgggcgcggcgggcggagggtcncaaagtgccctgcccacccccgatgctctttccgaagcgcatcaactacgtggccccgatgctcgcctccgccgccatcctgctcctcctcctctcgggctacttcgagctcccctccatctccaccccggcgccgctcctcgcgggggaagggggcttccccaccgcggtcaactccgtcggatcgcgcgaccgggaaccccttcacttcggtcccccaaggcctttcgaggccttgggacgccgcccgtcgggttggcccccgcggcccgagccaaagtccgcccgccgcggggcctgggntttgcgcctcagacgcccgcggnnnnnnnnnnnnnccnannccnttccncnncccacccaacaaancnccaaccccccaaaaaataaacacaccgaccccaccaccactaaacccacactagcacccccaccccacaccaacaaccccacaccgcacacccacgcccccccg

SEQ ID NO: 34551 - protein, 151 aa, Zea mays
  misc_feature: Ceres CLONE 1413177-F
  misc_feature (94)..(94): Xaa is any aa, unknown, or other
  misc_feature (102)..(102): Xaa is any aa, unknown, or other
  misc_feature (103)..(103): Xaa is any aa, unknown, or other
  misc_feature (104)..(104): Xaa is any aa, unknown, or other
  misc_feature (105)..(105): Xaa is any aa, unknown, or other
  misc_feature (106)..(106): Xaa is any aa, unknown, or other
  misc_feature (107)..(107): Xaa is any aa, unknown, or other
  misc_feature (108)..(108): Xaa is any aa, unknown, or other
  misc_feature (109)..(109): Xaa is any aa, unknown, or other
  misc_feature (111)..(111): Xaa is any aa, unknown, or other
  misc_feature (116)..(116): Xaa is any aa, unknown, or other
  misc_feature (117)..(117): Xaa is any aa, unknown, or other
MLFPKRINYVAPMLASAAILLLLLSGYFELPSISTPAPLLAGEGGFPTAVNSVGSRDREPLHFGPPRPFEALGRRPSGWPPRPEPKSARRGAWXLRLRRPRXXXXXXXXPXPTQQXXNPPKNKHTDPTTTKPTLAPPPHTNNPTPHTHAPP

SEQ ID NO: 34552 - DNA, 685 bp, Zea mays
  misc_feature: Ceres CLONE 1413181-F
caaagctggagctccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaatcttggtgagttctgttcatgtgcatttgagcttacgcatctatgatacgcgccttagggattgtgatctgtgattaggggttgtgaaattgagatgccattttagggattgtggaagtgtgaactgtgccttactgaaatcgagatgccatttgagcaagtttcaactattttgttggattggcgaggttatgagaccttttcagata

SEQ ID NO: 34553 - DNA, 741 bp, Zea mays
  misc_feature: Ceres CLONE 1413188-F
  misc_feature: Encodes the peptide sequence at SEQ ID NO. 34554
  misc_feature (465)..(465): n is a, c, t, g, unknown, or other
  misc_feature (466)..(466): n is a, c, t, g, unknown, or other
  misc_feature (510)..(510): n is a, c, t, g, unknown, or other
  misc_feature (563)..(563): n is a, c, t, g, unknown, or other
  misc_feature (564)..(564): n is a, c, t, g, unknown, or other
  misc_feature (694)..(694): n is a, c, t, g, unknown, or other
aaaagctggagctccccgcggtggcggccgctctagaactagtggatcccccgggctgcaggaattcgcacgagaccattacctagaacatcctaatcgaaaaatccaaatcccgatcagtcgccgcccaagcctagcagatccgccggcgagcgcgcgggggcaatgggtgtcgtctcggcagcggcggacgcgattgtcgcggttttctccctcaccatcgtcgtcgcggcgccgctactcgacgcgcagtccgtcctcccgcataccctctacccggcgccgctcctggaactcaagcgctggtacgccgccgagtttggcgactacctcgtggcccagtcccccggcttcttccgtggccttgtttgcctcgagctcgccttccaatggccgctcgccgtcgccacactctacggcatcctcacccgccgcccgctgggctgccaccacctccctcatggnnccggcgttggcaccctcacctccatgtctgcaattctttggtgnagatgtttaggttcaggcaaatcaacaccaaagttgctttcagatgtatgttnnccttatgctgtttttgctgtcattgctattactacgtggactttgctcatgctctggacgcactactgctggttcatcacttgggccttctgcccggaaagaagagggtctagatcagcaggacacttgnaagaaattttcggtttgagacagtggcgccagagcactaatgctggt

SEQ ID NO: 34554 - protein, 192 aa, Zea mays
  misc_feature: Ceres CLONE 1413188-F
  misc_feature (101)..(101): Xaa is any aa, unknown, or other
  misc_feature (115)..(115): Xaa is any aa, unknown, or other
  misc_feature (133)..(133): Xaa is any aa, unknown, or other
  misc_feature (177)..(177): Xaa is any aa, unknown, or other
MGVVSAAADAIVAVFSLTIVVAAPLLDAQSVLPHTLYPAPLLELKRWYAAEFGDYLVAQSPGFFRGLVCLELAFQWPLAVATLYGILTRRPLGCHHLPHGXGVGTLTSMSAILWXRCLGSGKSTPKLLSDVCXPYAVFAVIAITTWTLLMLWTHYCWFITWAFCPERRGSRSAGHLXEIFGLRQWRQSTNAG

SEQ ID NO: 34555 - DNA, 679 bp, Zea mays
  misc_feature: Ceres CLONE 1413189-F
  misc_feature (536)..(536): n is a, c, t, g, unknown, or other
  misc_feature (648)..(648): n is a, c, t, g, unknown, or other
ggagctccccgcggtggcggccgctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccgtccgtgcgagccgcttcacccgtcggtgttttttttttttggtggaaagtagatagtgtgcgatttcaggaatcttctcgagctagctagtagctacatccctgggtttgtgtgggtagctagcggcagatgtaataacctaggtggcttttttgtaagagtactaggtgcttangtagatccatctgggaggtggaagatatcgatgctcgaagttgggaagtttgtttgccccccattgcttgtgttctaagggctggtggctgattcggccccggcccgggggntttggctaactttcccggctggggctaaaaa

SEQ ID NO: 34556 - DNA, 743 bp, Zea mays
  misc_feature: Ceres CLONE 1413190-F
  misc_feature: Encodes the peptide sequence at SEQ ID NO. 34557
  misc_feature (372)..(372): n is a, c, t, g, unknown, or other
  misc_feature (392)..(392): n is a, c, t, g, unknown, or other
  misc_feature (415)..(415): n is a, c, t, g, unknown, or other
  misc_feature (418)..(418): n is a, c, t, g, unknown, or other
  misc_feature (423)..(423): n is a, c, t, g, unknown, or other
  misc_feature (431)..(431): n is a, c, t, g, unknown, or other
  misc_feature (433)..(433): n is a, c, t, g, unknown, or other
  misc_feature (440)..(440): n is a, c, t, g, unknown, or other
cagagctggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggnctacggtgtctctctccagncagagcgacacctttcaaggagntcntcagnctcccccngnggcacgntgttctccttcgccgaccccgacggggaacggcggttccagcgcgaaagccagcgaaggggggccccaagcccgggcccggcgggaaagaacaagtccgggaaagggcaaaattccgaaaaggcccaggcgtttccaaatcccccccgggggggggaaagccaattcccgggaaaaatcggttccccgccctccccggggccttgggaaagggctccttggtttctcccggggcccttttggggaaagaggcgggggggaatctccccccccgggggggggttctaaagggggggagaaaatc

SEQ ID NO: 34557 - protein, 165 aa, Zea mays
  misc_feature: Ceres CLONE 1413190-F
  misc_feature (49)..(49): Xaa is any aa, unknown, or other
  misc_feature (57)..(57): Xaa is any aa, unknown, or other
  misc_feature (58)..(58): Xaa is any aa, unknown, or other
  misc_feature (59)..(59): Xaa is any aa, unknown, or other
  misc_feature (62)..(62): Xaa is any aa, unknown, or other
  misc_feature (63)..(63): Xaa is any aa, unknown, or other
  misc_feature (65)..(65): Xaa is any aa, unknown, or other
MSQSSPLFSVARAHAGAGGRAVAAALLLRRRPIAQLPHSIHGLRCLSPXRATPFKEXXXLPXXHXVLLRRPRRGTAVPARKPAKGGPKPGPGGKEQVRERAKFRKGPGVSKSPPGGGKPIPGKNRFPALPGALGKGSLVSPGALLGKEAGGNLPPRGGVLKGGRK

SEQ ID NO: 34558 - DNA, 734 bp, Zea mays
  misc_feature: Ceres CLONE 1413193-F
  misc_feature: Encodes the peptide sequence at SEQ ID NO. 34559
  misc_feature (363)..(363): n is a, c, t, g, unknown, or other
caaagctggagctccccgcggtggcggccgctctagaactagtggatcccccgggctgcaggaattcgcacgagaccattacctagaacatcctaatcgaaaaagggaagccgcaggcagcatctgcatctctcgcccacctccgctccgcctactgctgctggtggtagggaggcggagaaggaggcccttgcgcccgcccgccggctcggatcagagccgtagcaaccaccacccatggcggacgtgcacgaacctttggtgcgccgtaagaggaagaaggttttggtggactacttggtgaagttccgatggatcctcgtgatcttcgtggtccttccctatttcactctgatctacttncacatcttcctgggtgacatgtggtccgccatgaaagtcgagaagaagcgccagaagcagcacgaccagaacgtgcagaaggtcgtgaagcggttccagcagaggaacccgagaaggacggtcttgttttgacggccaggaagccctggatcccttttggcatgccaacgtggactacaagggggggaaggttttttcaggggcaactttttttccttgggaaattccttgaaatcaaaaaaaaaaggatgggttccaaagggcaaacctccttttcaaagggggaaaaaaaaccaaaattcccgcccaaactttttttttttgttggggggcccccccaattacaaaaaccctcttgttgggggggggtt

SEQ ID NO: 34559 - protein, 85 aa, Zea mays
  misc_feature: Ceres CLONE 1413193-F
  misc_feature (42)..(42): Xaa is any aa, unknown, or other
MADVHEPLVRRKRKKVLVDYLVKFRWILVIFVVLPYFTLIYXHIFLGDMWSAMKVEKKRQKQHDQNVQKVVKRFQQRNPRRTVLF

SEQ ID NO: 34560 - DNA, 689 bp, Zea mays
  misc_feature: Ceres CLONE 1413194-F
  misc_feature: Encodes the peptide sequence at SEQ ID NO. 34561
  misc_feature (482)..(482): n is a, c, t, g, unknown, or other
  misc_feature (503)..(503): n is a, c, t, g, unknown, or other
  misc_feature (545)..(545): n is a, c, t, g, unknown, or other
  misc_feature (564)..(564): n is a, c, t, g, unknown, or other
aaagctggagctccccgcggtggcggccgctctagaactagtggatcccccgggctgcaggaattcgcacgagaccattacctagaacatcctaatcgaaaaattcgcggcttcgcctgatcgcgtacgccgcttcgtcctgattctcaatctctggtgctcccatgaagaaagacagggaatgaaggaccgccacctcgcgctgaaccagacccagagggtccgcctcgaggccgcgcttcaagagctccagtccgttgcgcccgccgccgcgcccgccgctgccgtcaccgtcgcgggcaccattcccgtcaatcaagaggacaacatcctcaaggggcatgggacgtcggaccaggacggggaggtggttgcgacgctctgcggggtggtggagcgggtcaacaagctggtctacgtccgcactcttcgcgcgagctgcagattctcgatggagatgaatgggggtctgcaagccgcgnatgccaagtactgggtttacnagggtggagggcgccgcggaatctaatctcagctacaccggntcatccctactatgctggncagggtatggcgggtcaagaagtttttaaatgacaagtcccagttgccaccaagttgatgggctttccaaggctggagaactccggggggggcaattccaaaattggttggttttgcaaaaaaaa

SEQ ID NO: 34561 - protein, 115 aa, Zea mays
  misc_feature: Ceres CLONE 1413194-F
  misc_feature (101)..(101): Xaa is any aa, unknown, or other
  misc_feature (108)..(108): Xaa is any aa, unknown, or other
MKDRHLALNQTQRVRLEAALQELQSVAPAAAPAAAVTVAGTIPVNQEDNILKGHGTSDQDGEVVATLCGVVERVNKLVYVRTLRASCRFSMEMNGGLQAAXAKYWVYXGGGRRGI

SEQ ID NO: 34562 - DNA, 637 bp, Zea mays
  misc_feature: Ceres CLONE 1413195-F
  misc_feature: Encodes the peptide sequence at SEQ ID NO. 34563
  misc_feature (131)..(131): n is a, c, t, g, unknown, or other
  misc_feature (274)..(274): n is a, c, t, g, unknown, or other
  misc_feature (321)..(321): n is a, c, t, g, unknown, or other
  misc_feature (322)..(322): n is a, c, t, g, unknown, or other
cgctctagaactagtggatcccccgggctgcaggaattcgcacgagaccattacctagaacatcctaatcgaaaaacctcctatggccaccgtcgactgccccctgccctctcccgcggacctcgacgacnacggattcccggctctaccctcatcccccgctgcctgtagcagcggcttcgcggaggacttctaccgcagcggcaccgactggtcctccttacgcgcccctccgccgctggggccgcccagaaggcaccccggtgtgaagganagagggaggcggctcggccgtgcagagcagcctcttccaggcgtggnnggatcgagaagccgcggcgggacgggcgtggggctgattcatcgcttgtgcagaggagcctcttccaggcatgggggatcgagagaccgcaaagggagggtctcgggggctgggagatccctccccctcctctcccctttccggttctttggtgggaaaggaacggaggggaagaaacaccaaggggggacggggggccgcccaaaaggccccctcgggggcccttctaacaagaaaatcccgggaaaaccattccggggggaggcttttcgggaggaaaaaatttgggggggggtcccgccaatttccttagcc

SEQ ID NO: 34563 - protein, 185 aa, Zea mays
  misc_feature: Ceres CLONE 1413195-F
  misc_feature (17)..(17): Xaa is any aa, unknown, or other
  misc_feature (64)..(64): Xaa is any aa, unknown, or other
  misc_feature (80)..(80): Xaa is any aa, unknown, or other
MATVDCPLPSPADLDDXGFPALPSSPAACSSGFAEDFYRSGTDWSSLRAPPPLGPPRRHPGVKXRGRRLGRAEQPLPGVXGSRSRGGTGVGLIHRLCRGASSRHGGSRDRKGRVSGAGRSLPLLSPFRFFGGKGTEGKKHQGGTGGRPKGPLGGPSNKKIPGKPFRGEAFREEKIWGGVPPISLA

SEQ ID NO: 34564 - DNA, 662 bp, Zea mays
  misc_feature: Ceres CLONE 1413196-F
  misc_feature: Translation starting site: 175
  misc_feature: SWISSPROT Homolog: EC 2.7.11.1 Non-specific serine/threonine protein kinase
ggagctccccgcggtggcggccgctctagaactagtggatcccccgggctgcaggaattcgcacgagaccattacctagaacatcctaatcaaaaccgcacgaattcgaatccgccggaggcggaggagacagcagccgggtgattgggttgggtacgcctctcgtctcggccgatggcgtcgctgttcggcaacggcggctacatctactcctcggggtcggagggggaggacgaggacgagggcacggaggggtaccggaaaggcgggtaccacgccgctcgccccggggatcgcttcgccggtgggcggttcgtcgcgcagcggaagatcggctggggcaacttctccaccgtctggctagcctacgacaccctcacagcagatttgtcgccctgaagatccagaggagcgcaagggattacgcgcacgcggctctccacgaatcgagctactgtcggctggtggcaaaggagaccccgacgaattcaaagtgcgtgcttcggttgttggaccatttcaagcacgctggccccacgggcagcacgtttggctgggtcaccgagttcctcggggatagcctgctccgggtgatacggaaaatcggaaaaaagggctttgggctgagcaaaagtgaagaaatctgccgatcagccatggcc

SEQ ID NO: 34565 - DNA, 696 bp, Zea mays
  misc_feature: Ceres CLONE 1413198-F
  misc_feature: Encodes the peptide sequence at SEQ ID NO. 34566
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaatatgagatgagaaggagactactagactagcagccgtatcactcactactcgctgcccgcgcccgatcgggcgcactgccctgtggtgtactggtgtgtcacgcccctcgtcactcaccccgtcacccgcaaccccatcttctattcttcccgacggcgctcctggcagcaggaacaagatgtccaatagggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagatttcgaatgatggatgccatgtcttccctttatgcggcacggatggaagaaatgggaagagatggtttgtttgatatcggggtagacagggaacaggtactgaatatggaggaggcccactgcctgtcctacattggatttgccggcatccctcctctgaanttgataccggggatgttaaagttgccctcagggagggccccaaattgggcttgcccacccaaattcaagaat

SEQ ID NO: 34566 - protein, 138 aa, Zea mays
  misc_feature: Ceres CLONE 1413198-F
  misc_feature (114)..(114): Xaa is any aa, unknown, or other
MSNRATHWCYACRRPIRLRGQDIACPNCNDGFIQEISEMGGILNTYGLIEPDFEERRARRFRMMDAMSSLYAARMEEMGRDGLFDIGVDREQVLNMEEAHCLSYIGFAGIPPLXLIPGMLKLPSGRAPNWACPPKFKN

SEQ ID NO: 34567 - DNA, 645 bp, Zea mays
  misc_feature: Ceres CLONE 1413201-F
  misc_feature (221)..(221): n is a, c, t, g, unknown, or other
  misc_feature (598)..(598): n is a, c, t, g, unknown, or other
aagctggagctccccgcggtggcggccgctctagaactagtggatcccccgggctgcaggaattcgcacgagaccattacctagaacatcctaatcaaaaaccgaaccaaacaacacacgtcaaagcggaaaacctcagaaaaccacaataaatcatcctcgtccaccactgcccccgctctgctgcaactccactcggcccggccgccctttcacccacnttgatcctctgatccgttggtgcttgaccgatccatgaacacccatatcggatccgtggaacgggccggcgtccaaacaaaacgttgggttgccggcgtccgggccgggggtgcccgattgggtcaaccccgggccagcccggggggaccctggcgggggggggaagggggcccctgggggccccaccctggggggggcccctggggaggggggggtcaaagaaagtatttcccggggtcccgggggaatttaacccctacctggtccaaaaccctgtatcgcaaagaccgggcggggccccccccggggggggggaaaaaaattcaaccccgggaaaacccccccacaagaaaaccccggcggggggggggccggncctttccccccccattataaaaacggggggggtcccggcggccaaac

SEQ ID NO: 34568 - DNA, 718 bp, Zea mays
  misc_feature: Ceres CLONE 1413205-F
  misc_feature (702)..(702): n is a, c, t, g, unknown, or other
caaagctggagctccccgcggtggcggccgctctagaactagtggatcccccgggctgcaggaattcgcacgagaccattacctagaacatcctaatcgaaaaatacagcgccggccgggccgttgcgtccgtccatcctcatccccatccgccacccaccccgcgcccctccttctcactccagtgctggctgccggccagctccgcccccggggtccttgagctggaggtgggtggcgacgtaaaggcgcccgcttgctttgccactgccggcgctcgtcatctccttacttattcatccctgcggccctgctacacatcggtgccgtgccgtgcgtgcttgattccgtcctgtcctgtgcttgccgtttctttggcttgtattgtaggtggcggtggatgaccagctctcggagttttctgaggcgaggatcggagggcgttgcgttaggtccgcggttggtgagcggcggtcggagcggtctcgcgcgcggcggggtcgttcgatgacgcaggaatcgcgctctgggagggtgggaatacctcgcgctcgcgctcaaggtgctcgattaatttactgcctgaggctgagggagggcgcgcctgtgagctgaaccgttcccgctgcactgactcctgagctcgggaaatggttgggagcgtgacatcaatggatcggtccacggcggcaatggcacggncacggaggagcggctg

SEQ ID NO: 34569 - DNA, 646 bp, Zea mays
  misc_feature: Ceres CLONE 1413207-F
  misc_feature: Encodes the peptide sequence at SEQ ID NO. 34570
  misc_feature (212)..(212): n is a, c, t, g, unknown, or other
  misc_feature (215)..(215): n is a, c, t, g, unknown, or other
  misc_feature (235)..(235): n is a, c, t, g, unknown, or other
  misc_feature (380)..(380): n is a, c, t, g, unknown, or other
  misc_feature (464)..(464): n is a, c, t, g, unknown, or other
  misc_feature (466)..(466): n is a, c, t, g, unknown, or other
tccccgcggtggcggccgctctagaactagtggatcccccgggctgcaggaattcgcacgagaccatacctagaacatcctaatcgaaaaaccccatctccagctccatccgcaccaacatctccaccaaccgacacggcgaggagatgaacgcgtcgcagttcatggacaagcagatcctcggcctcgccgcctccgcctccccgtccggnggnggcgcggggggcggtggggntgtgaatctcagcgatctgatgatcccgatcccccaggaggacggcgaggaccgtctccgtcgccggcgtagcagtagcagcgtcaacggcacatcagacgacatgctacccagctacgatttccagccgatccgcaccgggggngccaccgccgccgcccccgtgtctcaggcctcgtggggatcgctcgactcccagcacccctcgcctctgctctggctccgccgncngctcatacaacctcaagagtgctggtatattgaagcacatgtgctgaagaaagtaggcatgaggaagacagagtaacttccctaagttactattgcagatattgatcgaaccatgaagaagtcctctgatacctttttgctgcactggaaaggggaagtccaaggcttcccagatggaga

SEQ ID NO: 34570 - protein, 131 aa, Zea mays
  misc_feature: Ceres CLONE 1413207-F
  misc_feature (30)..(30): Xaa is any aa, unknown, or other
  misc_feature (107)..(107): Xaa is any aa, unknown, or other
MNASQFMDKQILGLAASASPSGGGAGGGGXVNLSDLMIPIPQEDGEDRLRRRRSSSSVNGTSDDMLPSYDFQPIRTGGATAAAPVSQASWGSLDSQHPSPLLWLRRXLIQPQECWYIEAHVLKKVGMRKTE

SEQ ID NO: 34571 - DNA, 632 bp, Zea mays
  misc_feature: Ceres CLONE 1413210-F
  misc_feature: Encodes the peptide sequence at SEQ ID NO. 34572
  misc_feature (547)..(547): n is a, c, t, g, unknown, or other
cgctctagaactagtggatcccccgggctgcaggaattcgcacgagaccattacctagaacatcctaatcgaaaactgttttgttctccttctcattcgactctgatgatgacgagacggttatcgttccccttctggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggcaagggcggtgcgagaaagagggtacgtgccgtcggtcacgtcggcgcctaatagtcggttccattctcgggctggcttcaggccgtcttccctggtcctttcggccagattcgtgtcancaatcatggggtggttaagtccgaatccccgatgcaagggccctgcggtgcgctaccttaacgataagggccccttgggggcccc

SEQ ID NO: 34572 - protein, 65 aa, Zea mays
  misc_feature: Ceres CLONE 1413210-F
  misc_feature (60)..(60): Xaa is any aa, unknown, or other
MAECVNSCIPTECAADPSGRQGRCEKEGTCRRSRRRLIVGSILGLASGRLPWSFRPDSCXQSWGG

SEQ ID NO: 34573 - DNA, 713 bp, Zea mays
  misc_feature: Ceres CLONE 1413212-F
  misc_feature: Encodes the peptide sequence at SEQ ID NO. 34574
  misc_feature (315)..(315): n is a, c, t, g, unknown, or other
  misc_feature (409)..(409): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (442)..(442): n is a, c, t, g, unknown, or other
  misc_feature (467)..(467): n is a, c, t, g, unknown, or other
  misc_feature (485)..(485): n is a, c, t, g, unknown, or other
  misc_feature (500)..(500): n is a, c, t, g, unknown, or other
caaagctggagctcaccgcggtggcggccgctctagaactagtggatcccccgggctgcaggaattcgcacgagaccattacctagaacatcctaatcgaaaaagaccatagtcatctcatccctcccaactccgctgctacgccttcttctacatcgcaatcacgcgcccgtccggctctcccccttctccctcgccctcacgcgctcacgccctcacctcagtcctcatcgctctcggccgcctgcttaaaccctccgctcgaaccggaacccaaccgagaacagatccaaaacgcaagccgcaccatgtctncgtgtcgcgggctcgcgcctcctccctaggatctctgcgctctccttctgcaccgcctccccggcaaccgccgccgcttcctcctcttcccaanggggggggggggggggnnnnngnnnngcggccnccgccgggagacccatccctcccangccgccccagactgcccngcaagccggggggcngcgctcaagttcgccgccttcgccgccgtgtccgccgcggttggcggcacgggctacgtcagctacgcttattctctagaggaagtggatcagatgacgcgggagctccggaagaagtcgaagcagcccattcctgaggatgcttctggctttgagaggtttcaggctatggcctattcagcagctatgaaagttcctgttgccgctattgag

SEQ ID NO: 34574 - protein, 40 aa, Zea mays
  misc_feature: Ceres CLONE 1413212-F
MTRELRKKSKQPIPEDASGFERFQAMAYSAAMKVPVAAIE

SEQ ID NO: 34575 - DNA, 595 bp, Zea mays
  misc_feature: Ceres CLONE 1413214-F
  misc_feature (157)..(157): n is a, c, t, g, unknown, or other
  misc_feature (162)..(162): n is a, c, t, g, unknown, or other
aagctggagctccccgcggtggcggccgctctagaatagtggatcccccgggctgcaggaattcgcacgagaccattacctagaacatcctaatcgaaaaatcttcctgctcaacatcagtagcagctttagctgtagcagcgccaccggccaccgncacgncatgggccacacggtgcacaagccccctggggcgatcaccgttgacaactcccccgcgcggggcctgggttggacccaaccggctccaccgaagggtccggggggggttcgattccagggaccccccaaaaggggggggaagttttccggcccggggtttttcgtttgtcccctttgggggaacggggggttcaaaaaagggggtttccccgggtttcttccccacaaggggggggtggggggcccccacccaaaggggtttttttttaaaaaaggggggggggccccaaggggggggggggaaaaattttttggggggcggaaaaaaaaggtcttcccaatttttcaaaaaccccaagttttcccaaaaaaaaaaaggggggggggaaaagaatttttgaaagggggtcccccccccggggagaaggcccgg

SEQ ID NO: 34576 - DNA, 650 bp, Zea mays
  misc_feature: Ceres CLONE 1413219-F
tggagctccccgcggtggcggccgctctagaactagtggatcccccgggctgcaggaattcgcacgagaccattacctagaacatcctaatcgaaaactccccccaccgccttgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcgccggcgctggctgccatgtggtgggcgtcggtgctcccagacggggtgtcgacggcctcccgccggggccctccgggttgggccggtgggtggggaaacctggttccaggggatcctggcagggactgcccttcattgaacgtgggggggcgacctcccgggaaaaaataacggcccattcttccccaagggggaagggggcagcgcaccctcctatcgggtccccctcggggggaattcacccccgaagggcttggggagaaaaagggcccccttgttcccgaagccggccccgaaaaaaagccccccccgcccctcccttttaggggggggaaagggaaccgtaaatttggggccctaaagcccccccgttggggggggtctcttggccc

SEQ ID NO: 34577 - DNA, 624 bp, Zea mays
  misc_feature: Ceres CLONE 1413220-F
  misc_feature: Encodes the peptide sequence at SEQ ID NO. 34578
  misc_feature (440)..(440): n is a, c, t, g, unknown, or other
gctctagaactagtggatcccccgggctgcaggaattcgcacgagaccattacctagaacatcctaatcgaaaagatctataccaccgaaggcgaggaagggggggccaaggacgagcgctttttcgtgccctctggccattgccgctgctcacgagcctcccgccccgcgctgccctgccctctgcggctctgccccaacgagccccaggagagccaggtaaaggagccgtcaaaatcccccgccgaggagcgcacgcaaggtcagacatggcgtcaaccgttaccttcagcccagttagcacccaagcgtgggttgatccataagccaaggaaccttggagccacaagctacgctgggcttaaaggtgccgagctttggctatgagtcatcatttcttgggtaggaacgcatccctctcggggcggctgttacctacnagggattgtgcccaaggcaaaagtcctggatctcagatatctccacaggcatcttacaaggtgggcgctgctccggggctgctgggtggcatcggtcaacctttggcctatttggattaagatgtcctcccctggtgtccaagctgcatctgggatgatattgcaaagggcaagggaggcgctg

SEQ ID NO: 34578 - protein, 58 aa, Zea mays
  misc_feature: Ceres CLONE 1413220-F
MSHHFLGRNASLSGRLLPTRDCAQGKSPGSQISPQASYKVGAAPGLLGGIGQPLAYLD

SEQ ID NO: 34579 - DNA, 695 bp, Zea mays
  misc_feature: Ceres CLONE 1413229-F
  misc_feature: Encodes the peptide sequence at SEQ ID NO. 34580
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (628)..(628): n is a, c, t, g, unknown, or other
caaagctggagctcaccgcggtggcggccgctctagaactagtggatcccccgggctgcaggaattcgcacgagaccatttacctagaacatcctaaaaaaaaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaagtcggggacggaggacgcgacgccggnnncgggggttgtcggagggcgaggctgaggaggacgacggcggcggcgtgaaggaggaaccgagggaggaggatgagggcgagctcgagggaggggaatggatgccacccatggaagggggtcgtgcgatacctggtggacagcaggctcgtcttcggaccatcgaagcgggtcgtggcgagntccaccgatgtcgcctgtgagtcacagttctcatccccattcttttgctgtgagtgccattttgatt

SEQ ID NO: 34580 - protein, 118 aa, Zea mays
  misc_feature: Ceres CLONE 1413229-F
  misc_feature (110)..(110): Xaa is any aa, unknown, or other
  misc_feature (111)..(111): Xaa is any aa, unknown, or other
MPLIDAAASAVAPPPPRRVAQLRFFSTRRPGILSLTATSCSPSPPPPVAAEVPAAPQEAKSKPRPRRYPKQYPGESVGVAEEMRFVAMRLRNPKRTTIKDKSGTEDATPXXGVVGGRG

SEQ ID NO: 34581 - DNA, 732 bp, Zea mays
  misc_feature: Ceres CLONE 1413232-F
  misc_feature: Encodes the peptide sequence at SEQ ID NO. 34582
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (55)..(55): n is a, c, t, g, unknown, or other
  misc_feature (57)..(57): n is a, c, t, g, unknown, or other
  misc_feature (58)..(58): n is a, c, t, g, unknown, or other
  misc_feature (732)..(732): n is a, c, t, g, unknown, or other
nnnnnnnnnaaaaaaannnaaaaaagaaaaagagaaagaaannnnncctcctctntnncaaagctgggactccccgcggtggcggccgctctagaactagtggatcccccgggctgcaggaattcgcacgagaccattacctagaacatcctaatcgaaaaattggatcctatgctctcctctccctgctcgcagtcagggcacagggactgcctccggagaccggagcaggccgcaagcgtccaggttcgagacgccagcacgctctcgcagtacagcagcattatcagggagcgtgccgtgggagtgggaggttgcctcaggtgcggagcagtcgccggcggcgaccatcggtgtctgagatgaaggagagaggcggctccagggcggcagtggacgagcgctacgcgcagtggaagtcgctcatccccgttctctacgactggtttgccaaccacaacctcgtttggccatccctctcctgccggtgggggccacagtttgagaaagctacctacaagaatcgtcaacgcctttacctatctgaacagaccgatggggagggtgcctaatactctgggtatcgcaaactgtgaagtttgtgaaaacaaggggttggagcctgctggaaaatattctcgcaatttaaccgaggaagcccggatcaccttttttgtaaagaaaggacaagacctatagctccacccctggggggaaagttaacaagaatcn

SEQ ID NO: 34582 - protein, 69 aa, Zea mays
  misc_feature: Ceres CLONE 1413232-F
  misc_feature: SWISSPROT Homolog: EC 2.3.1.48 Histone acetyltransferase
MKERGGSRAAVDERYAQWKSLIPVLYDWFANHNLVWPSLSCRWGPQFEKATYKNRQRLYLSEQTDGEGA

SEQ ID NO: 34583 - DNA, 657 bp, Zea mays
  misc_feature: Ceres CLONE 1413234-F
  misc_feature: Encodes the peptide sequence at SEQ ID NO. 34584
  misc_feature (512)..(512): n is a, c, t, g, unknown, or other
  misc_feature (580)..(580): n is a, c, t, g, unknown, or other
  misc_feature (596)..(596): n is a, c, t, g, unknown, or other
tcaccgcggtggcggccgctctagaactagtggatcccccgggctgcaggaattcgcacgagaccattacctagaacatcctaatcaaaaaaaaatcgagctgtcccctccctgtgctctactgctcttgcgccttgctagcttgcttgcttccctgctccctccctcctcctcctcgtcgcctcttctctggttcttcctggtgtttgccggagcgaggctaggcgcaaggggagggagctgcgctcagccagagctcatcggcgctacgcaagcgcgctgcctggtgtgctgcattgccgaactatcaggggaaaacactgaaataatggaaatcagcttattgcataatgaatctgatgcaggaagcaccagtttgctaccgctgccattgttgtcatatggtccaagatcaatggttccaatacaagtaccaccatcatcagactttgagagtatcctgtcaccagagccaatctacagtgatcttcagttgaaagagatgaactacnatgcagcagcaatggatgaaaagcactgagttccttcacttgattcttagtggcaatgatgaaggatnacatagcacactgaanttacagttttggggatttttgggaacttctatgtctcagaaaacttttctgctctcatttt

SEQ ID NO: 34584 - protein, 70 aa, Zea mays
  misc_feature: Ceres CLONE 1413234-F
  misc_feature (62)..(62): Xaa is any aa, unknown, or other
MEISLLHNESDAGSTSLLPLPLLSYGPRSMVPIQVPPSSDFESILSPEPIYSDLQLKEMNYXAAAMDEKH

SEQ ID NO: 34585 - DNA, 787 bp, Zea mays
  misc_feature: Ceres CLONE 1413239-F
  misc_feature: Encodes the peptide sequence at SEQ ID NO. 34586
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
ggggagggagggcgaggggaacgccggggaaaacactcctctnnnnccacannnnnnaaaaagctggagctccaccgcggtggcggccgctctagaatagtggatcccccgggctgcaggaattcgcacgagaccattacctagaaatcctaagcgaaaacaagctgcttctcaatattccacaatccacacatccggaccgagcgcgaccccacctcccagatctcatctgcgacgacctcctccctcgcgatccgctccgtctccccccaccgccaccgctgccgctgccgcctcccccaccgaggtcttgtcttcggcgatccagccggagcccgcgacgacgacgatgtacgggtgggagatgctatcgctcaacatacacgatggggtacctggaaggcatccgtggcggggcaaccgtttcgggtcctcctccaacggggcagactaccaaaaccctcgggcaagtggcgaagcccctcccccgacttccaatgatgcaccccccacccgccccagaaaaacgggccccctaaccccccaaaaaagaaacctttcccccctttgccccccaacggataattgggggaagaaagtgaacccccttaaaactaaggccgatggagccaccaggcaccctgcttggtgcccagggcccaatgggaacccattaaacaaacgcctttgtggccgggcaaaataacctttatggggccaaccagggtctgtggaccaagggtggcgcccctttaattggggacaacagggagccaccccggaactg

SEQ ID NO: 34586 - protein, 118 aa, Zea mays
  misc_feature: Ceres CLONE 1413239-F
MYGWEMLSLNIHDGVPGRHPWRGNRFGSSSNGADYQNPRASGEAPPPTSNDAPPTRPRKTGPLTPQKRNLSPLCPPTDNWGKKVNPLKTKADGATRHPAWCPGPNGNPLNKRLCGRAK

SEQ ID NO: 34587 - DNA, 656 bp, Zea mays
  misc_feature: Ceres CLONE 1413241-F
  misc_feature: Encodes the peptide sequence at SEQ ID NO. 34588
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatggccacccttctcgctacgagcttcttctttgtactcctatgcagctcgctacaagtacgtggcgtgaactacacgttcgtgaaggacgcggcgctggcgcccaccgtgtcgtactacgactacatcatcgtgggcggcggcacggccgggtgcccgctggccgccacgctgacagagcgcttccgcgtgctgctgctggagcgcgacgcctcgccctacgacgacgaccgcatcggagacatggtccgcttcgcggacacgctgtcggacacctccccgggctcgcccgcgcaacgcttcgtgtcggaggacggcgtcatcttctcgcgcccgcgggtgctggacggcggcatctgcatcaacgccggcttctaaggcgggtcagcaagactaacgtgggggcgtcagatgggacctgagcgccncgaggaagcgtacctgtgggtgttagacatggtgccgttcaccgtagctggggc

SEQ ID NO: 34588 - protein, 125 aa, Zea mays
  misc_feature: Ceres CLONE 1413241-F
  misc_feature: SWISSPROT Homolog: EC 4.1.2.10 Mandelonitrile lyase
MATLLATSFFFVLLCSSLQVRGVNYTFVKDAALAPTVSYYDYIIVGGGTAGCPLAATLTERFRVLLLERDASPYDDDRIGDMVRFADTLSDTSPGSPAQRFVSEDGVIFSRPRVLDGGICINAGF

SEQ ID NO: 34589 - DNA, 641 bp, Zea mays
  misc_feature: Ceres CLONE 1413242-F
  misc_feature: Encodes the peptide sequence at SEQ ID NO. 34590
  misc_feature (284)..(284): n is a, c, t, g, unknown, or other
gctctagaactagtggatcccccgggctgcaggaattcgcacgagaccattacctagaacatcctaatcgaaaaaagaagctttacagtgaacgagtgagtatgtgcggcatacttgctgtgctcgggtgcgccgacgaggccaagggcagcagcaagaggtcccgggtgctggagctgtcgcggcggctgaagcaccggggccccgactggagcggcctccggcaggtgggcgactgctacctctctcaccagcgcctcgccatcatcgacccgggctctggncgacagcccctctacaacgaggacagtccggtgggccgtcggcgtcaaacggggagatctaccaccacctggacctcaggagccggctcgcccgggggaggccacagctttcaggaccggagggaatgggcaagtcatcgcgcacctggacgagaggatgggaaaaaaaggttcggggaaatggtggggcgggggctttctcccttgggggtggtggaacactccccatggggaaccgggggggaaaaaatttcttcaagggtggttccgaagcccctttggggggggacgcctcttccttgggaggggggggccaaaagggggcccggggggtttttctcccggagaaaaagaagg

SEQ ID NO: 34590 - protein, 180 aa, Zea mays
  misc_feature: Ceres CLONE 1413242-F
  misc_feature: SWISSPROT Homolog: EC 6.3.5.4 Asparagine synthase (glutamine-hydrolyzing)
MCGILAVLGCADEAKGSSKRSRVLELSRRLKHRGPDWSGLRQVGDCYLSHQRLAIIDPGSGRQPLYNEDSPVGRRRQTGRSTTTWTSGAGSPGGGHSFQDRREWASHRAPGREDGKKRFGEMVGRGLSPLGVVEHSPWGTGGEKISSRVVPKPLWGGTPLPWEGGAKRGPGGFFSRRKRR

SEQ ID NO: 34591 - DNA, 671 bp, Zea mays
  misc_feature: Ceres CLONE 1413243-F
  misc_feature: Translation starting site: 201
  misc_feature: SWISSPROT Homolog: EC 4.3.1.5 Phenylalanine ammonia-lyase
  misc_feature (411)..(411): n is a, c, t, g, unknown, or other
  misc_feature (528)..(528): n is a, c, t, g, unknown, or other
  misc_feature (532)..(532): n is a, c, t, g, unknown, or other
  misc_feature (581)..(581): n is a, c, t, g, unknown, or other
  misc_feature (618)..(618): n is a, c, t, g, unknown, or other
  misc_feature (623)..(623): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (654)..(654): n is a, c, t, g, unknown, or other
  misc_feature (655)..(655): n is a, c, t, g, unknown, or other
ggagctccccgcggtggcggccgctctagaactagtggatcccccgggctgcaggaattcgcacgagaccattacctagaacatcctaatcgaaaatccaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgcccgggcgtcgctgtcgagctncgacgaagaggcccgcccccgcgtcaagccagccagcgagtggatcctcgactgcatcgcccacggcggcgacatctacggcgtcaccacggggtttccgcggcacctcccacgcgnaaancaaaggacgggcccgcggctccaagtcgaagctgctcaggatctcaacngccggaatctcggacccgggaggacggacacctttcnccccngggagccacccgcgggggnnnntttgttggnnccaaaaaccccctccc

SEQ ID NO: 34592 - DNA, 646 bp, Zea mays
  misc_feature: Ceres CLONE 1413247-F
  misc_feature: Translation starting site: 267
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
tccccgcggtggcggccgctctagaactagtggatcccccgggctgcaggaattcgcacgagaccattacctagaacatcctaatcgaaaagtttcttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcggcatggatgaaccccttcttggcaatggtcttaagaccagcgggaaaagagagagcctggtagtggccgaggtcagaaaacagatgtaccttgctgggccactcatcgctgcatggatcctacagaacatttgtccagatgatatcttatcattggtttgtcggtcacctttggtgagcttgccctctccagtgccctcatcgccacctccttttgcagggcgttactgggcttcagcttattgtctggcatggcgagcagctggacaccactgtgtggggcaaatcgtggggggcaaagcagaactattcttcttggcatcaaccagcagagggcaatcctgtgctcatcagaannnncccgggggggtgggattatctgg

SEQ ID NO: 34593 - DNA, 634 bp, Zea mays
  misc_feature: Ceres CLONE 1413248-F
  misc_feature: SWISSPROT Homolog: EC 2.7.1.90 Diphosphate--fructose-6-phosphate 1-phosphotransferase
  misc_feature (331)..(331): n is a, c, t, g, unknown, or other
tggagctccccgcggtggcggccgctctagaactagtggatcccccgggctgcaggaattcgcacgagaccattacctagaacatcctaatcgaaaaagcctcgaagaagagagatgaacaccgacttcggcgcgcccaaggagctcgcgggaggccggcaacaacggcggagcctgtaccagccccgactgccgcgatgtctcacgggaccgacgcgaagggcggagtacggtgaggcgacaacaacatcgatgccacctgtagccaagacgtggcgcaggcactgcctgacacctttggccatgcggtcgtcagattcatcgcgccggncgccggcgtcgtcgccgttgatgacgcgcacccgatcgaggtgccgtgggtgttctctggcaggcagacgcagagagggcacacgtcgtctggggctccatgacgtactgaaagcctaccagccgcagagggttgctctacggataccacggggggatggagggactgtttgacaaaagacgctggacatcactaacaatggttctggctactataaaaaccaggtggtttcctatttcctcgggaggaagatccatgcggaacggaactactaaaaaagtggatggctggaatgaccacctg

SEQ ID NO: 34594 - DNA, 710 bp, Zea mays
  misc_feature: Ceres CLONE 1413250-F
  misc_feature (282)..(282): n is a, c, t, g, unknown, or other
  misc_feature (284)..(284): n is a, c, t, g, unknown, or other
aaagctggagctccccgcggtggcggccgctctagaactaagtggatcccccgggctgcaggaattcgcacgagaaccattacctaagaacatcctaatcgaaaaaatcgacctagctaggcacaagaagcgctagacgccgcagcgcagcacgcaccacccaccgagcggcggcggaggcagggcaatccgcagggagcagaggccgcgcgcgcaggcatgggcgcgccggtgcacggcgccctcgcctttcctcctgctcctgggggggccaaggggcgncncccgaggagacggcgccgcaggaacccacattgccagccaccggctccggcgctaccggcgcgccggcggtcggggtcaactccaactccgtgctggtggcgctgctggattcgcactacacggagctggcggagctggtggagaaggcgctgctcctgcagacgctggaggacgccgtcgggaagcacaacgtcaccatcttcgcgccgcgaaacgaggcgctggagcgggacctggacccggagttcaagcgcttcctgctggagccgcgcaacctcgggtcgctgcaggcgctgctgctctaccacgtcctcccctcgcgcctgccctccgactcctggcccgcggcgtcccaccccccgctgtccgggcgaggaggtcgagctccgcgcccggatgggcgtcgggcaacgccgccgtaagcc

SEQ ID NO: 34595 - DNA, 732 bp, Zea mays
  misc_feature: Ceres CLONE 1413251-F
  misc_feature: Encodes the peptide sequence at SEQ ID NO. 34596
  misc_feature (443)..(443): n is a, c, t, g, unknown, or other
  misc_feature (450)..(450): n is a, c, t, g, unknown, or other
  misc_feature (474)..(474): n is a, c, t, g, unknown, or other
  misc_feature (528)..(528): n is a, c, t, g, unknown, or other
  misc_feature (536)..(536): n is a, c, t, g, unknown, or other
  misc_feature (537)..(537): n is a, c, t, g, unknown, or other
  misc_feature (559)..(559): n is a, c, t, g, unknown, or other
aagctggagctccccgcggtggcggccgctctagaactagtggatcccccgggctgcagcaattcgcacgagaccattacctagaacatcctaatcgaaaaaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatgtcatctgactccacggccgccgtgacggtggacggcagcgcgcttgcggggcgcgcgctgggccgcggcgggcacgcggcacatggtcgggggtgtgggcatccccgtcacctccctcgcgtcccgtgcccngcgcggncggggtccgctttctcgctttccngcacgagcaagtccgcgggggtacgccgccgccggctacggtttcctcaggggntccccggnngccctactccaccggctcgggnccaggatgggtccacggggtttcgggggcttcttccaagcccacggcaaaggcctggcggttcctcaggaatttccggatacctggaaaccaggttggaccccggaagggggcaaatttccgggaacttgaaaaaaattgccgcccctaaacccttttcgcaagggtcgcggg

SEQ ID NO: 34596 - protein, 98 aa, Zea mays
  misc_feature: Ceres CLONE 1413251-F
  misc_feature (17)..(17): Xaa is any aa, unknown, or other
  misc_feature (48)..(48): Xaa is any aa, unknown, or other
  misc_feature (56)..(56): Xaa is any aa, unknown, or other
MVGGVGIPVTSLASRAXRGRGPLSRFPARASPRGYAAAGYGFLRGSPXALLHRLGXRMGPRGFGGFFQAHGKGLAVPQEFPDTWKPGWTPEGGKFPGT

SEQ ID NO: 34597 - DNA, 691 bp, Zea mays
  misc_feature: Ceres CLONE 1413253-F
  misc_feature: Encodes the peptide sequence at SEQ ID NO. 34598
  misc_feature (574)..(574): n is a, c, t, g, unknown, or other
  misc_feature (577)..(577): n is a, c, t, g, unknown, or other
  misc_feature (578)..(578): n is a, c, t, g, unknown, or other
  misc_feature (590)..(590): n is a, c, t, g, unknown, or other
  misc_feature (608)..(608): n is a, c, t, g, unknown, or other
  misc_feature (609)..(609): n is a, c, t, g, unknown, or other
  misc_feature (621)..(621): n is a, c, t, g, unknown, or other
  misc_feature (622)..(622): n is a, c, t, g, unknown, or other
gctggagctccccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggcagctgcatcaacgccggcttctacacgcgggccagcgacgactacgtgncgnngcgtcgggtggnaacctgggcgcccgccgnngcgcgtaaccgnngggtggggaagggcacgtggtggcgttcaaacgagctgggggcccccccctggagaaggcccgctttta

SEQ ID NO: 34598 - protein, 182 aa, Zea mays
  misc_feature: Ceres CLONE 1413253-F
  misc_feature: SWISSPROT Homolog: EC 4.1.2.10 Mandelonitrile lyase
  misc_feature (144)..(144): Xaa is any aa, unknown, or other
  misc_feature (145)..(145): Xaa is any aa, unknown, or other
  misc_feature (149)..(149): Xaa is any aa, unknown, or other
  misc_feature (155)..(155): Xaa is any aa, unknown, or other
  misc_feature (160)..(160): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSEDGVINSRPRVLGGGSCINAGFYTRASDDYVXXRRVXTWAPAXARNRXVGKGTWWRSNELGAPPWRRPAF

SEQ ID NO: 34599 - DNA, 740 bp, Zea mays
  misc_feature: Ceres CLONE 1413254-F
  misc_feature: Encodes the peptide sequence at SEQ ID NO. 34600
  misc_feature (322)..(322): n is a, c, t, g, unknown, or other
  misc_feature (360)..(360): n is a, c, t, g, unknown, or other
  misc_feature (389)..(389): n is a, c, t, g, unknown, or other
  misc_feature (395)..(395): n is a, c, t, g, unknown, or other
  misc_feature (446)..(446): n is a, c, t, g, unknown, or other
  misc_feature (705)..(705): n is a, c, t, g, unknown, or other
aaagctggagctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggnacccgtcccttctaacccgtcgcggagtccgcccgcgncgcgcactgcgaacggacgctgtacccgnagctcntgctgtcgacactcgcggaacatcccggactaccacagaagccgttccggnacgtcattggcgcggccggggaaccgaacccaggaacgggtgggtcccccgttcagaaaatgctcgaattactgaaggaaaggccctggtcggggggggacccctggccaaaaaaaatgcctgggatttgttgcccccaaaaaagggaaaaatccggcccaaaccccaaaattgggccccccccggaaaaggggggtcccgcccccggggggggttttcaaagggccccccgccccccaaaaaaaacacctttaaaaanggtttttttttggggacacaaaacaaccaaaccgg

SEQ ID NO: 34600 - protein, 32 aa, Zea mays
  misc_feature: Ceres CLONE 1413254-F
MPPIPKRGEHLLVLLIVACAATAATAAGTRPF

SEQ ID NO: 34601 - DNA, 636 bp, Zea mays
  misc_feature: Ceres CLONE 1413255-F
  misc_feature: Translation starting site: 160
  misc_feature (386)..(386): n is a, c, t, g, unknown, or other
  misc_feature (410)..(410): n is a, c, t, g, unknown, or other
  misc_feature (435)..(435): n is a, c, t, g, unknown, or other
  misc_feature (438)..(438): n is a, c, t, g, unknown, or other
  misc_feature (456)..(456): n is a, c, t, g, unknown, or other
aaagctggagctccccgcggtggcggccgctctagaactagtggatcccccgggctgcaggaattcgcacgagaccattacctagaacatcctaatcgaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccngcggggcgtggctcgcccgcgcgnacttcctgctgacgtgcgacccggnggncgtccagcactggctggngtcaaacacggggggctacgacaggggccgagactttgcggagatgttcgacttcctgggcgacgggcttgtggttgcggacccccggttgggggcccgcccaccggaacggtccccgccaccgtttttgagaccccggggggttcggggccttttgtccgggggaacaatgggggggca

SEQ ID NO: 34602 - DNA, 738 bp, Zea mays
  misc_feature: Ceres CLONE 1413256-F
  misc_feature: Encodes the peptide sequence at SEQ ID NO. 34603
  misc_feature (318)..(318): n is a, c, t, g, unknown, or other
  misc_feature (332)..(332): n is a, c, t, g, unknown, or other
  misc_feature (366)..(366): n is a, c, t, g, unknown, or other
  misc_feature (390)..(390): n is a, c, t, g, unknown, or other
  misc_feature (417)..(417): n is a, c, t, g, unknown, or other
  misc_feature (421)..(421): n is a, c, t, g, unknown, or other
  misc_feature (452)..(452): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
caaagctggagctccccgcggtggcggccgctctagaactagtggatcccccgggctgcaggaattcgcacgagaccattacctagaacatcctaatcaaaaactctcgattcggaaaacctccaaccctagccgcgatccgacaacgcctccatccctagccgactgctgcaagcttcagagctcaagagtcagggcgccatggcgacagagacggagaactcttcgcctttcaggctgagatcaaccagctgctctcactcatcatcaacaccttctattccaacaaggagatcttcctccgggagctcatttccnactcttccgatgcngtggacaaaatcaggttcgagagcctcactgacnagagcaagctcgatgcgcagccgnagctggtcatccacattgtaccagacnaggnttcgaaaacgctcttcatcatcgacgggggnttcgggatgaccaaggtcgaacctttcaaaaacctcgggtacatcgcccggtcccgggacaaaggggttccgggaaacccttgcttgttggcccttaagggcttaaaatggggacaatcccgggggccggtttccaacctggccaacccccccccacaaggggggcctcccgggccccccattatataattgtgcnnnnggttgggggggggaaaccccaggggggggggggttttttctttgttacttcggacacccggggggggagtatttttggggggaaaaa

SEQ ID NO: 34603 - protein, 60 aa, Zea mays
  misc_feature: Ceres CLONE 1413256-F
MTKVEPFKNLGYIARSRDKGVPGNPCLLALKGLKWGQSRGPVSNLANPPPQGGPPGPPII

SEQ ID NO: 34604 - DNA, 719 bp, Zea mays
  misc_feature: Ceres CLONE 1413259-F
  misc_feature: Translation starting site: 397
  misc_feature: SWISSPROT Homolog: EC 4.1.1.8 Oxalyl-CoA decarboxylase
  misc_feature (365)..(365): n is a, c, t, g, unknown, or other
  misc_feature (382)..(382): n is a, c, t, g, unknown, or other
  misc_feature (386)..(386): n is a, c, t, g, unknown, or other
  misc_feature (449)..(449): n is a, c, t, g, unknown, or other
  misc_feature (560)..(560): n is a, c, t, g, unknown, or other
acaagctggagctccccgcggtggcggccgctctagaactagtggatcccccgggctgcagcaattcgcacgagaccattacctagaacatcctaatcgaaaaaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatgtcatctgactccacggccgccgtgacggtggacggcagcgcgcttgcggcgncggcgctgggcccgcgncggncacgcggcacatgtttcggggtggtgggcatccccgtcacctccctcgcgtcccgtgccgccngcggccggggtccgcttcctcgctttccgcaacgagcagtccgcggggtacgccgccgccgcctacggcttcctcacgggctccccgggcgccctactcaccgtctccggnccaggatgcgtccacggggctcgcgggcctctcccacgccaccgccaacgcctggccgctcctcatgatctccggatcctgcgatcaggctgacgccggcaggggcgacttccaggagctcgaccagatcgccgccactaagcccctcgccaagctcgt

SEQ ID NO: 34605 - DNA, 709 bp, Zea mays
  misc_feature: Ceres CLONE 1413261-F
  misc_feature: Encodes the peptide sequence at SEQ ID NO. 34606
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcgaaaaacagaaccctgcaactgcaagctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacggtcagcagcgcggcgtggcgctcctgagcgagaccatgtccacacccgtgctggtggccacagcaaaccagaccctggaggacgtcgagtgcacttcgaggncgtgtcgggggcttccggtcgtcaacagcggcctcagatgcgtcggggtgatcgtcaagaacgaccgggcaagagcctctcatggttccagacagagaattcggaagggatgactctccggttattaaattatcgtttgaa

SEQ ID NO: 34606 - protein, 166 aa, Zea mays
  misc_feature: Ceres CLONE 1413261-F
  misc_feature (130)..(130): Xaa is any aa, unknown, or other
MACVSTFQSCPIARRAKINTRSRGCSSSVAKGSSPPAFQFQCRASTFAADTSLRLELDENPEAIISGAWPGNCSLLSYDDLRAYLESQETAAQADGQQRGVALLSETMSTPVLVATANQTLEDVECTSRXCRGLPVVNSGLRCVGVIVKNDRARASHGSRQRIRKG

SEQ ID NO: 34607 - DNA, 694 bp, Zea mays
  misc_feature: Ceres CLONE 1413263-F
  misc_feature (459)..(459): n is a, c, t, g, unknown, or other
  misc_feature (460)..(460): n is a, c, t, g, unknown, or other
  misc_feature (493)..(493): n is a, c, t, g, unknown, or other
  misc_feature (494)..(494): n is a, c, t, g, unknown, or other
  misc_feature (510)..(510): n is a, c, t, g, unknown, or other
  misc_feature (511)..(511): n is a, c, t, g, unknown, or other
  misc_feature (573)..(573): n is a, c, t, g, unknown, or other
  misc_feature (622)..(622): n is a, c, t, g, unknown, or other
caaagctggagctccccgcggtggcggccgctctagaactagtggatcccccgggctgcaggaattcgcacgagaccattacctagaacatcctaatcgaaaaaggatctggagaccctacccgcctgagccctcagccggccgcgcggtgcggcaccgcaccaccgccaccgagccacgaacccgccggagtaccgacccgcctgcgccctccgctggccgtgcggcgtggcagcgcaccacctacggcgggctgcggcaccgccccggccctcgcaccagttccgcggcgacgtggtccagcagcaccgccaggccgcctacggccatttcactcgcggcttctgagcatctacctgcacttcttcaattacctgcagctttcatcgtatttcctttgcattgcataccgtgcagccacctctgcacatgatgtttcggatgttatcttattattannaaactagatttactcatgtttttcttcctctgnncatattgctgatttgnnaactaatctttctgtgggggttatgcactgttaattttccctgtcattttaggtctaattgnattcgacactctcatcgtagaactgcctcataagttttgtgccctctgnatacatctccatcggctccatgtccaaggactgcaacaccctttttgtatcaggttttaaaccggcttttga

SEQ ID NO: 34608 - DNA, 694 bp, Zea mays
  misc_feature: Ceres CLONE 1413264-F
  misc_feature: Encodes the peptide sequence at SEQ ID NO. 34609
aaagctggagctccccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgc

SEQ ID NO: 34609 - protein, 50 aa, Zea mays; identical to SEQ ID NO: 23071
  misc_feature: Ceres CLONE 1413264-F
  misc_feature (1)..(50): Pfam Name: AdoMetDC_leader Pfam Description: S-adenosyl-l-methionine decarboxylase leader peptide

SEQ ID NO: 34610 - DNA, 735 bp, Zea mays
  misc_feature: Ceres CLONE 1413267-F
  misc_feature: Encodes the peptide sequence at SEQ ID NO. 34611
  misc_feature (559)..(559): n is a, c, t, g, unknown, or other
  misc_feature (682)..(682): n is a, c, t, g, unknown, or other
  misc_feature (704)..(704): n is a, c, t, g, unknown, or other
  misc_feature (705)..(705): n is a, c, t, g, unknown, or other
  misc_feature (707)..(707): n is a, c, t, g, unknown, or other
  misc_feature (710)..(710): n is a, c, t, g, unknown, or other
acaagctggagctccccgcggtggcggccgctctagaactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaaaagcgggcggcggcggaggaggaggaggctggcggcatgctactcatcgagacctgctgccggcgccgctcaaggccagtgtcagtgcggctcctctagccccggtggcggcggcggaagcggcagcctcgtggcaagaacaccgcgcgcgttctcgagctgctccagctacgccgcctcgtctggcctgcgcgccggcggcggccgtccatctcggcacccagcacaagctgacggcgctcctcgtcgcgctcgcgctcctcctcgtcctccctcccctcctctcgtggaggggtcccccggtggtgtcgccccgcaggaatggcgaggatccgcangccacgtggagaggatcaacaagacccccgtgcgctccattgagagccaggacggcaacaccatcgacctgcgtggcggcgcacgagcagcacggcctggacacccgcttctcagggcgcagnccgtccagacgaccgcgaaagnngnccnaagggggggggggggggcggtcccc

SEQ ID NO: 34611 - protein, 181 aa, Zea mays
  misc_feature: Ceres CLONE 1413267-F
  misc_feature (123)..(123): Xaa is any aa, unknown, or other
  misc_feature (164)..(164): Xaa is any aa, unknown, or other
  misc_feature (171)..(171): Xaa is any aa, unknown, or other
  misc_feature (172)..(172): Xaa is any aa, unknown, or other
  misc_feature (173)..(173): Xaa is any aa, unknown, or other
MQPSADSRKKSGRRRRRRRLAACYSSRPAAGAAQGQCQCGSSSPGGGGGSGSLVARTPRAFSSCSSYAASSGLRAGGGRPSRHPAQADGAPRRARAPPRPPSPPLVEGSPGGVAPQEWRGSAXHVERINKTPVRSIESQDGNTIDLRGGARAARPGHPLLRAQXVQTTAKXXXRGGGGAVP

SEQ ID NO: 34612 - DNA, 702 bp, Zea mays
  misc_feature: Ceres CLONE 1413268-F
  misc_feature: Translation starting site: 209
  misc_feature: SWISSPROT Homolog: EC 2.7.11.1 Non-specific serine/threonine protein kinase
  misc_feature (306)..(306): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (461)..(461): n is a, c, t, g, unknown, or other
  misc_feature (608)..(608): n is a, c, t, g, unknown, or other
  misc_feature (640)..(640): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaatccctttccccaacccccgaagccgagccagcgaaccaccccgcccgcagccgcaagcaagcagccaagcagtgtgaactgaccgtccgttccgtccagcccaccatggaggcgccgccggtaccggagctcatggatctggacgcgccccctcccgccgcagccgacgccgcagccgcggcgccggttccccccgccgtcgncgacaagaaagaaggaaggggaagggggagacactgttacgggtcacatcatctccaccaccatcggtgggaagaacggcgagccgaagcggaccatcagttacatggcagannncgtgtcgtgggtacgggctcattttgggatcgtcttccanggctaagtgttttggagactggagagaccttccccatttaagaaggtgctgcaaggatcggcgttacaagaaccgggagctgcaaacttatgcgtgccatggagcaccccaacgtcatctgcctgaagcactgcttcttctcacacnagcaagggaacgagttgtttctaaaccttgtncatggaattttgtcccgagaccctgttacgtggtctggaacactacagcacgcgnaaccaga

SEQ ID NO: 34613 - DNA, 692 bp, Zea mays
  misc_feature: Ceres CLONE 1413271-F
  misc_feature: Encodes the peptide sequence at SEQ ID NO. 34614
  misc_feature (368)..(368): n is a, c, t, g, unknown, or other
  misc_feature (371)..(371): n is a, c, t, g, unknown, or other
  misc_feature (392)..(392): n is a, c, t, g, unknown, or other
  misc_feature (420)..(420): n is a, c, t, g, unknown, or other
  misc_feature (436)..(436): n is a, c, t, g, unknown, or other
  misc_feature (441)..(441): n is a, c, t, g, unknown, or other
  misc_feature (477)..(477): n is a, c, t, g, unknown, or other
aaagctggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcgncgntggtgggggagcgcgtggcgntgaagctcagggggtacttcgacctcgncaaagaggagatcgancaggncgtgcgcgctgaggagtgggggctccccgacgaggncaccgcgcactaccgcaacgcgatgcgggtcatgctcgaggccaaaggcgcgcgcgtccccgatggcgtctccctcagcgagagggggcaggtcaggggtgaaccagaagaagatcgccagtggcaggcccaggtcgaggagcgctcaaaggggttggtcaaaaaaacgttgaaggggccctgctgaaaagggcccaaaagggtggtggaaaaat

SEQ ID NO: 34614 - protein, 133 aa, Zea mays
  misc_feature: Ceres CLONE 1413271-F
  misc_feature (36)..(36): Xaa is any aa, unknown, or other
  misc_feature (37)..(37): Xaa is any aa, unknown, or other
  misc_feature (44)..(44): Xaa is any aa, unknown, or other
  misc_feature (53)..(53): Xaa is any aa, unknown, or other
  misc_feature (58)..(58): Xaa is any aa, unknown, or other
  misc_feature (60)..(60): Xaa is any aa, unknown, or other
  misc_feature (72)..(72): Xaa is any aa, unknown, or other
MSFLRSLADSFSSLLFSSGGGAVSMDAAGAAPSPAXXVGERVAXKLRGYFDLXKEEIXQXVRAEEWGLPDEXTAHYRNAMRVMLEAKGARVPDGVSLSERGQVRGEPEEDRQWQAQVEERSKGLVKKTLKGPC

SEQ ID NO: 34615 - DNA, 723 bp, Zea mays
  misc_feature: Ceres CLONE 1413272-F
  misc_feature: Encodes the peptide sequence at SEQ ID NO. 34616
  misc_feature (308)..(308): n is a, c, t, g, unknown, or other
  misc_feature (309)..(309): n is a, c, t, g, unknown, or other
  misc_feature (626)..(626): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
acaagctggagctccccgcggtggcggccgctctagaactagtggatcccccgggctgcaggaattcgcacgagaaccattaacctagacatcctaaaaaaaactgaggcgagggagagagagagagagtgagtgagtgagtaatgggcggttcatcaggccttgtggactggagaggacggccggtgaacaccaagaagcatggaggagtgagagcttcaattttcattcatgcgctggtgctgctcagcaacgtagccaacattgccagtatactgaatcttgtaagctatctgcgcgaggagatnncacatggatgtcgcgagggcgacgacgatggcgagcaatttctttgccgcgctgcaaatgttctccatcccagcagccttccttgctgactcctacatcaagcgtttctacactgtcctcatctttggcccaattgaaatactgggctactccctgctcgcggtccaagcacatgtcccatccctgcacccaccaccgtgcgtccctggacaagagacaagtacgtgtgagttccgtgagcggttcgaacctgagcctgctcctcctgggtctctacctgatccccatcggcgatgggggcggctcgggcatgcctnccggctctcgnnngggagccagttcgacaggtcggatcccgtagagcagaggcaggagtcgagcttcttcaacttgtacacttctccggtctcgact

SEQ ID NO: 34616 - protein, 137 aa, Zea mays
  misc_feature: Ceres CLONE 1413272-F
  misc_feature (105)..(105): Xaa is any aa, unknown, or other
  misc_feature (109)..(109): Xaa is any aa, unknown, or other
MDVARATTMASNFFAALQMFSIPAAFLADSYIKRFYTVLIFGPIEILGYSLLAVQAHVPSLHPPPCVPGQETSTCEFRERFEPEPAPPGSLPDPHRRWGRLGHAXRLSXGSQFDRSDPVEQRQESSFFNLYTSPVST

SEQ ID NO: 34617 - DNA, 722 bp, Zea mays
  misc_feature: Ceres CLONE 1413274-F
  misc_feature: Encodes the peptide sequence at SEQ ID NO. 34618
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaactggaacaaaagttgttcttggtacagactacagagcgtagagcgagtgggtatcggacacttctctggcaattgcagattatctccgaatctgtatgaactgactgccgcggtccattccgtctgaagaccctcctcctacctaattatttttctctgtcgtgacgtgaaatgccagcgcgcagcttcttgatccgttccggctgatcccgtggaccggacttggggttgggggaggccctctgtctccatggatgaggcagcagggctgctgttgcaagaagagggtggaggtgtggaccaagaagctctcctccttccacttccacaggatgttggcctttacacaggtgatggatctgttgatgtcaaagggcgccctgcgttaaagggcactacaggcaattggaaagcatgctttttcatcctagggaatgaatgttgtgaaaggctggcctactacggaattgcaaaaaacctagttacttatttgaaagtgaagcttcatctaggcaacctcgaggctgcaagacatgttaccacttnggcaggggacatgctatctcactccccctttgttggagcatcttagcagactctcgtttggggaaatatgggac

SEQ ID NO: 34618 - protein, 113 aa, Zea mays
  misc_feature: Ceres CLONE 1413274-F
  misc_feature (99)..(99): Xaa is any aa, unknown, or other
MDEAAGLLLQEEGGGVDQEALLLPLPQDVGLYTGDGSVDVKGRPALKGTTGNWKACFFILGNECCERLAYYGIAKNLVTYLKVKLHLGNLEAARHVTTXAGDMLSHSPFVGAS

SEQ ID NO: 34619 - DNA, 697 bp, Zea mays
  misc_feature: Ceres CLONE 1413275-F
  misc_feature: Encodes the peptide sequence at SEQ ID NO. 34620
  misc_feature (1)..(1): n is a, c, t, g, unknown, or other
  misc_feature (140)..(140): n is a, c, t, g, unknown, or other
  misc_feature (433)..(433): n is a, c, t, g, unknown, or other
  misc_feature (487)..(487): n is a, c, t, g, unknown, or other
naaagctggagctccccgcggtggcggccgctctagaactagtggatcccccgggctgcaggaattcgcacgagaccattacctagaacatcctaatcgaaaacacgctagtagaaatccctccaaacccaacgcctacnattacaaagatacaccgcctcccgcttccttctccgccatacctcgtgtccgacgagccctagggaacgcgagaccggccgtcggcgagagaaggactcgaatggagtggcgcaagggagttgcgggttcgctccacgtttacggcggcggccatggcgtccaagaagcaggtggggcttgggaggcgcggttcccgctcagaaccagaatgaacggcggcgatgccgccagactggtcaggaagccaatggatacatttccacagccagcggcggcaagaggccgtagggancttgtcgacgttggcaatcttatgaatggccggccttctcttgtgaaccatcgnaagcaagcggttgcggcagcggcaaccagtcataaaccactcaacgtcggcaacaagaagccacttgttcctcaggcagcagcaagaggcctgcgacccccttgccgacgttacgaatcttatgatcaaagaccgtgctgctcctgcaaatcgtcagaaggctggtggatgctgtgtttaacagggaacgggaaggcagtaaagctgaaa

SEQ ID NO: 34620 - protein, 152 aa, Zea mays
  misc_feature: Ceres CLONE 1413275-F
  misc_feature (64)..(64): Xaa is any aa, unknown, or other
MEWRKGVAGSLHVYGGGHGVQEAGGAWEARFPLRTRMNGGDAARLVRKPMDTFPQPAAARGRRXLVDVGNLMNGRPSLVNHRKQAVAAAATSHKPLNVGNKKPLVPQAAARGLRPPCRRYESYDQRPCCSCKSSEGWWMLCLTGNGKAVKLK

SEQ ID NO: 34621 - DNA, 732 bp, Zea mays
  misc_feature: Ceres CLONE 1413280-F
  misc_feature: Translation starting site: 343
  misc_feature: SWISSPROT Homolog: EC 2.7.7.7 DNA-directed DNA polymerase
  misc_feature (277)..(277): n is a, c, t, g, unknown, or other
  misc_feature (361)..(361): n is a, c, t, g, unknown, or other
  misc_feature (369)..(369): n is a, c, t, g, unknown, or other
  misc_feature (412)..(412): n is a, c, t, g, unknown, or other
  misc_feature (430)..(430): n is a, c, t, g, unknown, or other
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaagccaagctttcctcaaaaactcgaaaaaggaacggagaaggcgtcctcgacgactgcccatggccgccgcccggacctagccagggattgttgtctcctgagtcccgacctaccaaggcggaaagggagagggggcgctgtggcgtcagggaaatactggaaccgagggctgagncgagcgcagagtcgggtggtatcgctttctttttcgtttctttttccggagggagagtattagggatgccggttgctaggccgnagccgcangagccccgggtgatcgcccatgtcgacatggactgcttctatngttcagtcgagcagcggnagaaccccgngctcaagggacagccgaccgcccgtgttgcataacaacggctggaaaggcgggggttttgatggccgtcagctacaaggctccgggaatggggggggaaaaggccatttgccggaaattaggcccaaaaaaatgcccgggaaataaatttggttaaggccccagggggcggggggaagggggtccttttattttaaaagaagggggggggggggggggtggcacccttttcaaaaagggggagaggggggggggctcccctcgggaaagttttttttgcctctttgtggggg

SEQ ID NO: 34622 - DNA, 728 bp, Zea mays
  misc_feature: Ceres CLONE 1413281-F
  misc_feature (367)..(367): n is a, c, t, g, unknown, or other
  misc_feature (465)..(465): n is a, c, t, g, unknown, or other
caaagctggagctccccgcggtggcggccgctctagaactagtggatcccccgggctgcaggaattcgcacgagaccattacctagaacatcctaatcaaaaaattgattggttgcttggttgcttgcttcgtttcacgctttccccttcctttgctgagatccaaaagctgagactcagcttgtcgatccatctgttctgtgcgcctactcgtatcttaggatccatctgtatgttgtttacttgttttcctgattgaatcgcgcattggatgcctggtggttggccttgctcctagtcttttcatttacacgagctttcgacgaagccgcgtctggtctgtctgctccatcacaagagcacgcanatggttcgatctgcccgtgcagatgattgctgcattcagtgggacgtcatgcacatccacgatggattgtagcgtcagcactctgatctttccttggncgattgttggtcgcagctgagtcccccaccccccaacaaacattactaaagtaactgcattgggcgggaaattaaggcgctaaaaactccacaacattggcggaacaagggggcccccgaaagggactgggggcccaatggggccccccggccggtacccccgggaagggcgaggggggaaataaaagggccttttttcccaaggggttttctcaaaggaaaggaaacccccccggggccccaacacaaaagggtaaagggca

SEQ ID NO: 34623 - DNA, 710 bp, Zea mays
  misc_feature: Ceres CLONE 1413282-F
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaaatcattagtcgattccacaatgtatatcttagatagtttaattttgataatggatccaagatatatcaccctatgcatcttcctagtacttgtcttacatggagatacaactttggcagaaacttgcaggcagtttgttaaatgggatccattctgctttagtgcaatatgcaaggcaagttgttttatagagggaaaatcctccgatggttcctatgtaaaggggcacagatgtgaatcaaatggatatcactctgtgtgtgtttgtcttttgtgtaaaaattaggtatccaatgacatgcggatctatcttcttttgttcctctttgtcatctaggagtgttgtctaaataattatatggtaaaatagttaactagtatgtttactattagagttatgtagcactatttaactagtcgttatttcttcaattcttatatctagaaacatgtttttagttgccaagcactttcataatatatttttggttttccttttatataaatttaaagagtcgtttgttagcttacaaaaaaaaaaaaaaaaagcttatcgataccgttcgacctccaagggggggcccgggtaccaattcgccctatagggn

SEQ ID NO: 34624 - DNA, 704 bp, Zea mays
  misc_feature: Ceres CLONE 1413285-F
  misc_feature: Encodes the peptide sequence at SEQ ID NO. 34625
  misc_feature (358)..(358): n is a, c, t, g, unknown, or other
  misc_feature (406)..(406): n is a, c, t, g, unknown, or other
  misc_feature (417)..(417): n is a, c, t, g, unknown, or other
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaaatctgtctatcttgatctcatctcctatcttcttcctcctagattctttcttccgcgcgccctctctctctctctccttcctgccttctgcctgcgggcggcccatgtccgtggcgcccctcctgccctgcgagctgcttctccagcgaaaaggttgctgcgccttgacgcaccaccgatccaccgccgcccaacccgagcgttctgtccggcagctaggtagcgagctgcgcggtggctgcgaccggaagcaggnagggggacagggcagcgaacgccgggcgattgccttgctttgctgggngctccgcccgngcgaggtggtcggtcgttccatgctggatgacaaggacttatttcagggtcgacctggagtattttacccgggggggagaggccccccgggtcttgggggggggggggggnaaataacccgccctccgtggcgggggaggcccccccatatccccccatgcccaaatgaaatggacccccgggaatcttaaatttttggggggggctttctcccggggttttttcaccagaggccccccccccccatttgttgaccccccccctgggggtttttttctacccccccc

SEQ ID NO: 34625 - protein, 133 aa, Zea mays
  misc_feature: Ceres CLONE 1413285-F
  misc_feature (51)..(51): Xaa is any aa, unknown, or other
  misc_feature (67)..(67): Xaa is any aa, unknown, or other
  misc_feature (71)..(71): Xaa is any aa, unknown, or other
  misc_feature (108)..(108): Xaa is any aa, unknown, or other
MSVAPLLPCELLLQRKGCCALTHHRSTAAQPERSVRQLGSELRGGCDRKQXGGQGSERRAIALLCWXLRPXEVVGRSMLDDKDLFQGRPGVFYPGGRGPPGLGGGGGXITRPPWRGRPPHIPPCPNEMDPRES

SEQ ID NO: 34626 - DNA, 713 bp, Zea mays
  misc_feature: Ceres CLONE 1413290-F
  misc_feature: Encodes the peptide sequence at SEQ ID NO. 34627
  misc_feature (503)..(503): n is a, c, t, g, unknown, or other
  misc_feature (504)..(504): n is a, c, t, g, unknown, or other
  misc_feature (515)..(515): n is a, c, t, g, unknown, or other
aaagctggagctccccgcggtggcggccgctctagaactagtggatcccccgggctgcaggaattcgcacgagaccattacctagaacatcctaatcaaaaaaccacgttcactccgtatctctcgtgcctttttcctttcctggttgcgacgagccgacgactgggcggacgccgctgccgccctacgccaggtcttcgtcggccccttcgacgagcacacacaagattcagtcgggaatgttgaatgcatagtgtaatttctgcgcaaaaagatggcatcagacgagttcatcagccttgacgcaccttgtgaggctgatgcgaaagatgaagggggagacgttcaggttaaagctcctgatgtgagtgggatggagcctctggtatcggatctccaaccagaagggaaagctggtgctgtgggtagtaatcccaagacatctgctgggaacctggatcttgaagaggggcaagtggaagatatggacctcgcggatgatnngacgtagtggnttggaaaggatcagctattagatgcttccattcagcccgagatcagtgttgcagctgtgcagactgtgatggggtttttgagtcaagctggacaaagggggacgggactgaaaatggaatattttatgagtcaacagcatctcttatggagaaagtccctcaagaggagttaaaagaagccgtgtgaatcaaaggacc

SEQ ID NO: 34627 - protein, 78 aa, Zea mays
  misc_feature: Ceres CLONE 1413290-F
  misc_feature (77)..(77): Xaa is any aa, unknown, or other
MASDEFISLDAPCEADAKDEGGDVQVKAPDVSGMEPLVSDLQPEGKAGAVGSNPKTSAGNLDLEEGQVEDMDLADDXT

SEQ ID NO: 34628 - DNA, 707 bp, Zea mays
  misc_feature: Ceres CLONE 1413291-F
  misc_feature: Encodes the peptide sequence at SEQ ID NO. 34629
  misc_feature (1)..(1): n is a, c, t, g, unknown, or other
  misc_feature (320)..(320): n is a, c, t, g, unknown, or other
  misc_feature (322)..(322): n is a, c, t, g, unknown, or other
  misc_feature (326)..(326): n is a, c, t, g, unknown, or other
  misc_feature (354)..(354): n is a, c, t, g, unknown, or other
naaagctggagctccccgcggtggcggccgctctagaactagtggatcccccgggctgcaggaattcgcacgagaccattacctagaacatcctaatcgaaaaaaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtcggcgagtgagcattgcggcggtccgcgatcgcccgtgggggagcatggcgtcngngggncggggtcggcccggcgggccggcgcggngtctggcgggctgaagacctacttcaagacccccgaggggcggcacaagctgcagtatgagaagacgcactcccccgccgtcgtgcactacagccacagcggcaagaccgtctcccagatgacagtggcatatttgaaggagaagccagcaggccagggttccacgccttcaaaccaagtgctggtagtggggatgcggtctgcagctgcaagacttctcggcactggggaatgggagccgggcacttagcttcgggagcatggtaccagcagggctgtctcaggaagagccgcatgggtgaagggaaattggtgtgtcgactagtgcaagtggatcgcaaggcatggcaaat

SEQ ID NO: 34629 - protein, 43 aa, Zea mays
  misc_feature: Ceres CLONE 1413291-F
MTVAYLKEKPAGQGSTPSNQVLVVGMRSAAARLLGTGEWEPGT

SEQ ID NO: 34630 - DNA, 705 bp, Zea mays
  misc_feature: Ceres CLONE 1413293-F
  misc_feature: Encodes the peptide sequence at SEQ ID NO. 34631
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (502)..(502): n is a, c, t, g, unknown, or other
  misc_feature (506)..(506): n is a, c, t, g, unknown, or other
  misc_feature (507)..(507): n is a, c, t, g, unknown, or other
  misc_feature (521)..(521): n is a, c, t, g, unknown, or other
  misc_feature (522)..(522): n is a, c, t, g, unknown, or other
  misc_feature (548)..(548): n is a, c, t, g, unknown, or other
  misc_feature (549)..(549): n is a, c, t, g, unknown, or other
  misc_feature (587)..(587): n is a, c, t, g, unknown, or other
  misc_feature (641)..(641): n is a, c, t, g, unknown, or other
  misc_feature (650)..(650): n is a, c, t, g, unknown, or other
  misc_feature (652)..(652): n is a, c, t, g, unknown, or other
  misc_feature (664)..(664): n is a, c, t, g, unknown, or other
  misc_feature (665)..(665): n is a, c, t, g, unknown, or other
aagctggagctccccgcggtggcggccgctctagaactagtggatcccccgggctgcaggaattcgcacgagaccattacctagaacatcctaatcgaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggtnnncagtaaatcctcaggacatggtctgccatatngtgnncgtgcttgtttggnngctattctgtttggtaccatcttggnntgtgtcatggcgcacttgatatctcgcgaaggatcttngggatgctgaaaatgctgtctgcaggggtgggtggtagcacatccctggctgtngcacactangntcttttactggnnggtctttggcagataaatttgggcgacaagacattcttcc

SEQ ID NO: 34631 - protein, 132 aa, Zea mays
  misc_feature: Ceres CLONE 1413293-F
  misc_feature (91)..(91): Xaa is any aa, unknown, or other
  misc_feature (102)..(102): Xaa is any aa, unknown, or other
  misc_feature (103)..(103): Xaa is any aa, unknown, or other
  misc_feature (108)..(108): Xaa is any aa, unknown, or other
  misc_feature (117)..(117): Xaa is any aa, unknown, or other
  misc_feature (130)..(130): Xaa is any aa, unknown, or other
MMRCAATGGGCVASWSGDWRLPAVNPCSVRMPTGNDGWCAGLRSRAADLAGLEMANLRGGVGGLFRASPRYGRLQATAAVDPEDIPLEKVXSKSSGHGLPYXXRACLXAILFGTILXCVMAHLISREGSXGC

SEQ ID NO: 34632 - DNA, 685 bp, Zea mays
  misc_feature: Ceres CLONE 1413295-F
  misc_feature: Translation starting site: 194
  misc_feature (494)..(494): n is a, c, t, g, unknown, or other
  misc_feature (525)..(525): n is a, c, t, g, unknown, or other
cagagctggagctccccgcggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgacgatcctgagtggttcttcttcgcccccaaggaccgcaagtaccccaacggtagcaggtcgaacagggcccaccgaggcgggatactggaaggctactggncaggacaggataatcaaatccgagggcgacnagcgcaagcagcataccatcggtatgaagaagaccctcgtctcccaccgtggtcgtgccccccagggcgagcgcacggggtggatatgcacgagtaccgcacaccgagcctgagttcgagtcccgcgaggagggtggttatggtctttatccgctcctcc

SEQ ID NO: 34633 - DNA, 725 bp, Zea mays
  misc_feature: Ceres CLONE 1413299-F
  misc_feature (515)..(515): n is a, c, t, g, unknown, or other
  misc_feature (673)..(673): n is a, c, t, g, unknown, or other
  misc_feature (676)..(676): n is a, c, t, g, unknown, or other
  misc_feature (677)..(677): n is a, c, t, g, unknown, or other
aaagctggagctccccgcggtggcggccgcttcaaaacaagtggatcccccgggctgcaggaattcgcacgagaccatttacctaagaacattcctaatcgaaaaacacacacacacatccttcaaataaacaagcgcacacgaacaaatacctcgccgccaataatggcctccagaacctccattgtgcttcgccacggcgatgcttagctacacaattcgcggttggtttgtgcaccactccgctcaccttccaggtcggtaagggatccaagcctggccaccttgatcttcaccccgaacgttgccaccatatccgacgtggagatcaaagaacatggtggcgatgacttctcctttacgcttaaggagggcccgaccggcaccttggacacttcgacaccaaggccccgctcaagtaccccctttgcatccgctttgcttgtcaagtctggtggttaccgcatcgccgacgacgtcttccccgccgattttcaaggttggcaccatttatnagacgacattcagcatctaatcagcatctgaagatgaactatatttcaaaagagcttcatctggcgcacgtgttagcaagacaatttttttctttggttattttatggcaccaacctacccagaaataaagtatgctacttgtcatatgatgccttgntgnngtggttgatatttttactaactaatacttattttatttagattttgaa

SEQ ID NO: 34634 - DNA, 704 bp, Zea mays
  misc_feature: Ceres CLONE 1413301-F
  misc_feature: Encodes the peptide sequence at SEQ ID NO. 34635
  misc_feature (599)..(599): n is a, c, t, g, unknown, or other
  misc_feature (672)..(672): n is a, c, t, g, unknown, or other
aaagctggagctccccgcggtggcggccgctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcggcgctggtggtcggcaccgtgtgcctcttctcctcctcttcggtcggcctgttgggcgcctcttacagggtccaggatgttgatgtaaataagttgtggagaactgcagattcaaatggttggagagcatcttctgcaccacgcacctactggcctcccccaccaactgaatctgagagcaatggctacttgcgcgtccggtgcaatggtggcttgaaccaacacgtagtgcaatatgtaatggctgttgtgctgcacggatcatgaatgctacactggtgctgccagaattagacacaatcattctggcatgatgaaagtggctttgtaggtatttatgatggtcccacttcatcnagacactgaatatgacgtccgaattgtatgagcattcctgaatcactacaatggaagacccagagctcaaggncagcagcttcgccaccagagatgcacgggatc

SEQ ID NO: 34635 - protein, 113 aa, Zea mays
  misc_feature: Ceres CLONE 1413301-F
MRRGLGSEASLRRRRGPARLWVAVAALVVGTVCLFSSSSVGLLGASYRVQDVDVNKLWRTADSNGWRASSAPRTYWPPPPTESESNGYLRVRCNGGLNQHVVQYVMAVVLHGS

SEQ ID NO: 34636 - DNA, 699 bp, Zea mays
  misc_feature: Ceres CLONE 1413305-F
ggagctccccgcggtggcggccgctctagaactagtggatcccccgggctgcaggaattcgcacgagaccattacctagaacatcctaatcgaaaaagcgtaatagctcaatttgatgacagacaattgactcacggactgtcatgatcaccttcatgaatatttcatagaacaatccctggatcgtccgcgccgtcgacgtacgactcgatccagttactcttgcgcattgaccggctaccatgtaccgagtcatctcaggactcgccctcgtatttaggcatgagtcaactgctcaaatgatgaatgcagcaattatgtgcgccagatcgatgacgcacagagatattcagccgtgttctgatctgcctgactgacgcgcgaacaaatgaaatacctcctcacgattcagacttacgagagtagagtattcctcctcgagtgcatgactatgtgcagtgatgaaagacaaagtgacaccacttcatcatgatgttagaaacgctctacagacatcaggatagcatctcaaactgcagcattcatgacgataggagcatatgacctcaacaaccctgacataaatgtgtcaaacaactggtgaaaaacctggcctaagaaacccatgccactaggaagtaaatgttttgagcccaaaattcagaaatacgggcaacttccttaactatggggtagcct

SEQ ID NO: 34637 - DNA, 736 bp, Zea mays
  misc_feature: Ceres CLONE 1413313-F
  misc_feature: Pfam Name: Glyco_hydro_2_N Pfam Description: Glycosyl hydrolases family 2, sugar binding domain
  misc_feature: SWISSPROT Homolog: EC 3.2.1.23 Beta-galactosidase
  misc_feature (460)..(460): n is a, c, t, g, unknown, or other
  misc_feature (516)..(516): n is a, c, t, g, unknown, or other
  misc_feature (585)..(585): n is a, c, t, g, unknown, or other
  misc_feature (586)..(586): n is a, c, t, g, unknown, or other
  misc_feature (608)..(608): n is a, c, t, g, unknown, or other
  misc_feature (639)..(639): n is a, c, t, g, unknown, or other
  misc_feature (711)..(711): n is a, c, t, g, unknown, or other
tggagctccccgcggtggcggccgctctagaactagtggatcccccgggctgcaggaattcgcacgagaccattacctagaacatcaatcgaaaatcaaaattactatgtgtatcatggtggcacaaattttggtcgcactactggggggccattcattacaactagctacgactatgatgcaccaattgatgaatatggacttcggagatttccgaagtgggcacatctgagggaacttcacaaatctataagattgtgtgagcacaccctgctttatggaaatacaacgtttctttctctgggtcctaaacaagaggctgatatttacagtgatcagtctggaggctgtgttgcattcctggcaaatattgattcagccaatgacaaagttgtcactttccgtaacaggcaatatgatcttcctgcttggtcagttagtattcttcctgactgcaggnaatgtggtgttcaacactgcaaaggtgcaatctcaaacttcaatggtgaccatggnttccagaaagtttgcaagcatcaaaacctgagcgatggagcattttcagggagagaaactgggatttgnngtaaaaaatgattttgtccggnaatgggatttgtggaccatattaatacgacnaaggactccaccgactacctatgtacacaaccaagttttagggggggggatggaaagtactcctcaaaaggnagccatgctgtccttaatatcgact

SEQ ID NO: 34638 - DNA, 722 bp, Zea mays
  misc_feature: Ceres CLONE 1413314-F
  misc_feature: Encodes the peptide sequence at SEQ ID NO. 34639
  misc_feature (377)..(377): n is a, c, t, g, unknown, or other
  misc_feature (657)..(657): n is a, c, t, g, unknown, or other
  misc_feature (710)..(710): n is a, c, t, g, unknown, or other
aagctggagctccccgcggtggcggccgctctagaactagtggatcccccgggctgcaggaattcgcacgagaccattacctagaacatcctaatcgaaaaaaaaaggcactgctcatcgatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgccntcgccgcgcgggacgtctccgccttcctcgccttcgcgctacccgcgtcctccgaagcctacggacgcctcactgccctggtgcccaaggaagatgatacgggagatgggatgttgatgctgcagctccagcaactcagatttcaatcaaacatggtctccctgagattgaaatatattgctacttgctcgtactggattttccttattgatcataagaaatatgatgaggctaaggcatgcgcaagtgtgagcattgctcgcctgaagatctaaccganaaaacgtgttgatgttttggcatcacgactgtacttctatactccttatgggnatgagcttacaa

SEQ ID NO: 34639 - protein, 96 aa, Zea mays
  misc_feature: Ceres CLONE 1413314-F
  misc_feature (65)..(65): Xaa is any aa, unknown, or other
MTEDVQMNDSEPQPAASAPAVGAPALSTLHHLKEIASVIEAGSLSKEVRRISRAFRLTVALRRRXRRAGRLRLPRLRATRVLRSLRTPHCPGAQGR

SEQ ID NO: 34640 - DNA, 714 bp, Zea mays
  misc_feature: Ceres CLONE 1413315-F
  misc_feature: Encodes the peptide sequence at SEQ ID NO. 34641
  misc_feature (400)..(400): n is a, c, t, g, unknown, or other
  misc_feature (402)..(402): n is a, c, t, g, unknown, or other
  misc_feature (403)..(403): n is a, c, t, g, unknown, or other
  misc_feature (478)..(478): n is a, c, t, g, unknown, or other
ggagctccccgcggtggcggccgctctagaactagtggatcccccgggctgcaggaattcgcacgagaccattacctagaacatcctaatcgaaaagagtaatttctcgtcttgtttcggctagggagcggggtggcttctccggccaaggctttcacagttttgtgtttgttgaatgtgtttgcaatggagattgaagaacacacagattcactttcaatagaggaacccatcacaaggctcccaccagatattattgaggggatacttctcaggcttccggtaaactctctaatgaggctgcgtcaagtctgcaagcaatggtggaacatggtcagcgtgccccgctttatcaaagaacatgcctatcatgcacccaagcacctcctcctttacttgncnntagtgaatatatctgcatcgctccatccaaagactgccaaaccatgtcttttgcacatcattaatggaaagtggntctccattgacatgggcctcatcgcatatggaccctgatgatcacctctttgcatcagggcacggttggctttgctccttacagacttccccctaaaggatttctacccttgcaacagggcaatggcctggtttctttggaacctgaccgcaaattggtggaccaacttcccaaattataacggtttggattttcccccgattacggggaaaaaaaaaggtggggggctttttccc

SEQ ID NO: 34641 - protein, 109 aa, Zea mays
  misc_feature: Ceres CLONE 1413315-F
  misc_feature (14)..(61): Pfam Name: F-box Pfam Description: F-box domain
  misc_feature (72)..(72): Xaa is any aa, unknown, or other
  misc_feature (73)..(73): Xaa is any aa, unknown, or other
  misc_feature (98)..(98): Xaa is any aa, unknown, or other
MEIEEHTDSLSIEEPITRLPPDIIEGILLRLPVNSLMRLRQVCKQWWNMVSVPRFIKEHAYHAPKHLLLYLXXVNISASLHPKTAKPCLLHIINGKWXSIDMGLIAYGP

SEQ ID NO: 34642 - DNA, 682 bp, Zea mays
  misc_feature: Ceres CLONE 1413317-F
  misc_feature: Encodes the peptide sequence at SEQ ID NO. 34643
cagagctggagctccccgcggtggcggccgctctagaactagtggatcccccgggctgcaggaattcgcacgagaccattacctagaacatcctaatcgaaaacccctaccccatcgatccccgccgcccgcctttccccgccattcttctagaacctacccagctctcggggaccttctctcccagcccgagatccctccccaccgagatcccgcgccgccatggtgtcgtgacggcggcggaggcggcgtcatggagcgggagcccaagtcccccgacgaccgccctgagcccgctgcggcggcggtgcagccgcagccgctggagtggcggtttgcgcaggtcttcggcgagcgcgccgcgggagaagatgtgcaagatgtggacataatctctgcaattgagtttgacaaatctgggaatcatcttgctactggagatagaggtggacgtgtggttttgttcgaaagaacagacattgctgataatgcttgtcaaagagaacttgagaggaaagaatatcttgtttctaggcatcctgagttccgttaccagaccgaatttcagagtcatgaacctgaagttgactacctaaaaagtttggaaatagaagagaagattaacaggatcaagtggtgcccaaccaaccaacaatgccactcttttctcttgtctaccaag

SEQ ID NO: 34643 - protein, 143 aa, Zea mays
  misc_feature: Ceres CLONE 1413317-F
MEREPKSPDDRPEPAAAAVQPQPLEWRFAQVFGERAAGEDVQDVDIISAIEFDKSGNHLATGDRGGRVVLFERTDIADNACQRELERKEYLVSRHPEFRYQTEFQSHEPEVDYLKSLEIEEKINRIKWCPTNQQCHSFLLSTK

SEQ ID NO: 34644 - DNA, 701 bp, Zea mays
  misc_feature: Ceres CLONE 1413318-F
  misc_feature: Encodes the peptide sequence at SEQ ID NO. 34645
  misc_feature (409)..(409): n is a, c, t, g, unknown, or other
  misc_feature (437)..(437): n is a, c, t, g, unknown, or other
tccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccggnagaagtacggcccatcttcacatggcgnatggggcagggaccctcctcgtggccacctgggggagtcatccaagaggcgtgggggaagcaggccccagttttcggggccggcccaagaaacccccccccccttcctttagggggggaaggaaccgaaaaatgggcccataggccccctgggggggggttgggcccaatttccccccaaaaaatggccccccccccggggggggtttttctggaaaaaaggggggggggggagggagaattatttggccccccaccgagagag

SEQ ID NO: 34645 - protein, 109 aa, Zea mays
  misc_feature: Ceres CLONE 1413318-F
  misc_feature (64)..(64): Xaa is any aa, unknown, or other
  misc_feature (73)..(73): Xaa is any aa, unknown, or other
MDVNDVLLVVLAAALAAMWWRRCSKTGGVDGLPPGPPGWPVVGNLFQVILQRRPFMYVVRDLRXKYGPSSHGXWGRDPPRGHLGESSKRRGGSRPQFSGPAQETPPPFL

SEQ ID NO: 34646 - DNA, 732 bp, Zea mays
  misc_feature: Ceres CLONE 1413320-F
  misc_feature: Encodes the peptide sequence at SEQ ID NO. 34647
  misc_feature (540)..(540): n is a, c, t, g, unknown, or other
  misc_feature (563)..(563): n is a, c, t, g, unknown, or other
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaaccacagcctccccagcatcagtgaagctcgctcaccgtcattcgacgacgccctcccgcacacacgaccatggccgcggcgatgaccggcagtgctcgcgccagcaccggctccttgctcgtgcttctcttcgtcgcgctggccggcgcgaccgccggggcgagtgccaccgttgccttcagcagcggcgacagcaacgcggcggcgctgctgacgacgccagcatcggcgtcccccgggcagctgaacggcatcatccagtgccttatgggctgcttcacgcagggtgtcggctgttcgttcggatgcatgggcaagcagggcgctgacctgccgctctgcatcatcagctgcgaccagaagagcgtcgtgtgcatggtcagctgcggccttgcgccgtcacccgcatcaccgtcgccgcccacgcccaaaccacagnaccccagcccgccacgccaaagncgcccggcccgcctacaccccggcgtacggcgccgctgccgtcaccggacgacatctggcctgatatgtcgacatggtgctggcagctctcacccgatcatcgtaacagnacgtaataatgaccccatggatcgggtggaaaggggcgggcggcaacccgggcctgcac

SEQ ID NO: 34647 - protein, 187 aa, Zea mays
  misc_feature: Ceres CLONE 1413320-F
  misc_feature (124)..(124): Xaa is any aa, unknown, or other
  misc_feature (131)..(131): Xaa is any aa, unknown, or other
  misc_feature (168)..(168): Xaa is any aa, unknown, or other
MAAAMTGSARASTGSLLVLLFVALAGATAGASATVAFSSGDSNAAALLTTPASASPGQLNGIIQCLMGCFTQGVGCSFGCMGKQGADLPLCIISCDQKSVVCMVSCGLAPSPASPSPPTPKPQXPSPPRQXRPARLHPGVRRRCRHRTTSGLICRHGAGSSHPIIVTXRNNDPMDRVERGGRQPGPA

SEQ ID NO: 34648 - DNA, 744 bp, Zea mays
  misc_feature: Ceres CLONE 1413321-F
  misc_feature: Encodes the peptide sequence at SEQ ID NO. 34649
cagagctggagctccccgcggtggcggccgcacttcactagtggatcccccgggctgcaggatttcgcacgagaccattacctagaacatcctaatcgaaaaatccaacgacccacactgagacgtcccctccccgctccgtcctctctcctctgccgccgagacgacgcgatggcggggtccgccgccttgccgccgctcgccgccttcgcgtcgctccttaccgcgcggtgcttcgccgccggcaggtccgcgctccggtccctgctcacgccgcgcctactgggggtgccgtttgtggacctcgcctactcgtcgctcccgcgcggcgcgccgccgtgcgcaagggggtaggtttgcgacgtgctcttccgggcgaacgtgtatgcctgctgggtgtgccaggtgctagagggaggtcgaggaaggcgtgtgccgcttcgttagactcgacccacgatcattcgagggtataggtgtgtatggctccagcgtgtggaggctctcgtcggacgactgacgacctcatggaagctggatggttaacttcggagtgcgttagcaaaccgcaaattatggcccaggaccatggatccgtgcaaggtgctccagatggaaggttgggattgtatgtacttgggctgtgcctggagggcttggatggcaccagaatggagggggatttttggtccttgccgggacaagggaaggcgcaactttgccgtggggaggcgctcctcaaac

SEQ ID NO: 34649 - protein, 60 aa, Zea mays
  misc_feature: Ceres CLONE 1413321-F
MAGSAALPPLAAFASLLTARCFAAGRSALRSLLTPRLLGVPFVDLAYSSLPRGAPPCARG

SEQ ID NO: 34650 - DNA, 723 bp, Zea mays
  misc_feature: Ceres CLONE 1413322-F
  misc_feature: Encodes the peptide sequence at SEQ ID NO. 34651
aaagctggagctccccgcggtggcggccgctctagaactagtggatcccccgggctgcaggaattcgcacgagaccattacctagaacatcctaatcgaaaaaaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggtgggggcaggggcggcgcccgaggagacggcgccgcaggaacccacattgccagccaccggctccggcgctaccggcgcgccggcggtcggggtcaactccaactccgtgctggtggcgctgctggattcgcactacacggagctggcggagctggtggagaaggcgctgctcctgcagacgctggaggacgccgtcgggaagcacaacgtcaccatcttcgcgccgcgaaacgaggcgctggagcgagacctggacccggagatgcagcgcttcctgctggagccgcgcaacctcaggtcgctgcaggtgctgctgctctaccacgtcctcccctcgcggctgccatccgactcatgtcccgcggcgttccaccccacgctgtccgggggaggacgtctagctacggggccgttatgcggcgtagcccacgccgccgtcaacgcgcccggaga

SEQ ID NO: 34651 - protein, 167 aa, Zea mays
  misc_feature: Ceres CLONE 1413322-F
  misc_feature (61)..(166): Pfam Name: Fasciclin Pfam Description: Fasciclin domain
MGAPVHGALALFLLLLVGAGAAPEETAPQEPTLPATGSGATGAPAVGVNSNSVLVALLDSHYTELAELVEKALLLQTLEDAVGKHNVTIFAPRNEALERDLDPEMQRFLLEPRNLRSLQVLLLYHVLPSRLPSDSCPAAFHPTLSGGGRLATGPLCGVAHAAVNAPG

SEQ ID NO: 34652 - DNA, 697 bp, Zea mays
  misc_feature: Ceres CLONE 1413324-F
  misc_feature: Translation starting site: 281
  misc_feature: SWISSPROT Homolog: EC 4.2.1.9 Dihydroxy-acid dehydratase
  misc_feature (461)..(461): n is a, c, t, g, unknown, or other
  misc_feature (554)..(554): n is a, c, t, g, unknown, or other
aaagctggagctcaccgcggtggcggccgctctagaactagtggatcccccgggctgcaggaattcgcacgagaccattacctagaacatcctaatcgaaaaaacccggctgtgctgtctcgtcgccttcctcccctcctgccggctgctgccgccgccagccgctgcaggcacgcttgccctctgctccctgtccatccactcatcattccccgtcatccaccaattcacaacccaaaaccctaaacccatttacctcaacgccaccgccgccgccgcgatgcagtccatggcgcccacctctccctcactcccggtggcaggccccgttccccgccgccgcctccagcgcgtccgcgccgccgcggtctccgacgagcccaaactcaacaagtacagcgcgcgcatcacggagcccaagtcgcagggcgcctcgcaggccgtgctctacgggtggcccntcaaccgacgccgacctccgcaagcggaaggtcggcgttctcttcggtgtggtacgaagggaacacctgcaacatgcacctgctccgcctcgncgaggcgtccgcgacggcgtccgtgaggccgggcatggtcggctccgaatcaccaccgtcggtgtcagcgacgccatctcatgggcacccggggcatgtgctacagcctccagtccggcgactcatcgcgacagcatcgagac

SEQ ID NO: 34653 - DNA, 698 bp, Zea mays
  misc_feature: Ceres CLONE 1413326-F
  misc_feature: Encodes the peptide sequence at SEQ ID NO. 34654
aaagctggagctccccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctccccaaggcgatggagaggaggaaggtaggcctcataaccattccgttcatcatcttaaacgagatattcgagaaggtggccacgttcgggctgacggccaacatgatcctgtacgtcaccgagcgatatctcatgaccagcgcctttgccaccgtcgacctctacttctggtatgccttctccaacttcctgcccatcttaggcgccgtgatcgccgacgcccgtctcgggcggttccggatcatcaccctcggatcctgcagtacgctcttcgagatgtgcctgctgtgactgacgactatccttccggtgtacaagaacacctcgaagtgcgcgccgtcactctcgtaagggtgcgcggagctgccgtggcacgtgccgttgctcttacagatcgtcgagttcaggaccctcagggggttcggaatcaggcctgcacgatggcggtcaggggctacctgatgaacaagggtgacatcggggccagagtgtgaggaccctacagaacttctttaactggg

SEQ ID NO: 34654 - protein, 106 aa, Zea mays
  misc_feature: Ceres CLONE 1413326-F
MEMSAMEEALPKAMERRKVGLITIPFIILNEIFEKVATFGLTANMILYVTERYLMTSAFATVDLYFWYAFSNFLPILGAVIADARLGRFRIITLGSCSTLFEMCLL

SEQ ID NO: 34655 - DNA, 706 bp, Zea mays
  misc_feature: Ceres CLONE 1413327-F
  misc_feature: Encodes the peptide sequence at SEQ ID NO. 34656
  misc_feature (667)..(667): n is a, c, t, g, unknown, or other
  misc_feature (682)..(682): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcgaaaacgaaagattcgagagatccctccaggaaagatttttcttccctcctccgacgccccagtccaccaacagactctataaagcagtcctcagtcacacacagaacgcacaagcgcaagccgggtaagaagactccgtacgccagtctgcgagttggatgaccttcttcttggccctcgtgtgcatcctcatcttgctagccatcgcctcctacgtccagtacactcgctggcaaaaggcgaaaggccgcttcggcggccatgggaggtctgctcccttgaagctgcctcctgactccatgggctggacttaccttggcgagaccctcgagctttactcccaggaccccagcttcttcttcgcttccaaacagaagaggcacggggagatcttcaagacgcaccttctgggttgcccgcgcgtgatgctggagagcccgaaggcgtcgcggatcgtgctgatgacgcaggtgcacctgtatcaggcgatctacccgcggagcaggagcgcatgatcgtgtcgtcggatcatctcttcagcagggcgactacacctccggcatcgaagntcgtccagggcggtnngaccgaagggctggggtgttgtt

SEQ ID NO: 34656 - protein, 118 aa, Zea mays
  misc_feature: Ceres CLONE 1413327-F
  misc_feature: SWISSPROT Homolog: EC 1.14.13.93 (+)-abscisic acid 8'-hydroxylase
MTFFLALVCILILLAIASYVQYTRWQKAKGRFGGHGRSAPLKLPPDSMGWTYLGETLELYSQDPSFFFASKQKRHGEIFKTHLLGCPRVMLESPKASRIVLMTQVHLYQAIYPRSRSA

SEQ ID NO: 34657 - DNA, 688 bp, Zea mays
  misc_feature: Ceres CLONE 1413329-F
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
ggagctccccgcggtggcggccgctctagaactagtggatcccccgggctgcaggaattcgcacgagaccattacctaataactcctatgcgaaaatccacgctgcatcaacgaccatctccaacgcactatgcagacagaatgacaggctatcagtgagtgcaacgcgcgaagagggatctgcgatgaactccttcttctcgacctatactgacgccccctccgtgcgccgacgacccgaactgcgcctgtggtggcaggacactccatgacatctacgactagcagaggtcgtcccacaagagagctatcagctgatgtagagcgacttctgcggggtcatgtcgtgccacctgccgaatcaatcgggccggcctttcaggagatgggcatccccctaaccggatggctttcttatttaagggggaccnnnnntcttcactttccctcgaagggcttaggttcttggaagccaaagagccttgccaattttttgggtttgcccaagatgtgctaaaaggttttaccccctttgtatttggcctaaaaaaaatcctttttttgacggaaaaaaacagagaatttttttccacttttttttttttcggggaaaaaaaaaaaaggggtcccccccccccccctttttaatgggttccccccacacccggggggcaaccggggggaaaaa

SEQ ID NO: 34658 - DNA, 705 bp, Zea mays
  misc_feature: Ceres CLONE 1413331-F
  misc_feature: Translation starting site: 115
  misc_feature: SWISSPROT Homolog: EC 2.7.1.90 Diphosphate--fructose-6-phosphate 1-phosphotransferase
  misc_feature (303)..(303): n is a, c, t, g, unknown, or other
  misc_feature (394)..(394): n is a, c, t, g, unknown, or other
  misc_feature (395)..(395): n is a, c, t, g, unknown, or other
  misc_feature (483)..(483): n is a, c, t, g, unknown, or other
  misc_feature (487)..(487): n is a, c, t, g, unknown, or other
  misc_feature (495)..(495): n is a, c, t, g, unknown, or other
  misc_feature (506)..(506): n is a, c, t, g, unknown, or other
  misc_feature (567)..(567): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaaagccaagaagaagagagatgaacaccgacttcggcgcgcccaaggagctcgcgggaggcctgcagcagcggcgggccctgtaccagccccgcctcccgccatgcctccagggaccgacggtaagggcggagtacggtgacgcgaccacaaccatcgatcccacctgtgcccaagccgtcgcgcaggccttcccgcacacctttggncagccgctcgtcagcttcgtcgcgccggccgccggcgccggcgccgttgaggagcgccacccgatcagggtggggcgtgttggtctctggnnaggcagtcgccgggagggcacaacgtcgtctggggcctccatgacgcacttaaagccttacatcctcagagcttgctctacggattcntcgntggcacgnagggactgttngcaaacaagacgttggaaatccccagacgatggtcttgcgtcctatagaacccaaggtggnttcgattggctccggagggagattcgatagaacccgactaaaaanccagtggaatggttgcatgaaaaaatggccaagcctgaacttgggagggttgcccatcctttgggggggggccctcaaatcaaagggtggcca

SEQ ID NO: 34659 - DNA, 694 bp, Zea mays
  misc_feature: Ceres CLONE 1413333-F
  misc_feature: Encodes the peptide sequence at SEQ ID NO. 34660
  misc_feature (384)..(384): n is a, c, t, g, unknown, or other
  misc_feature (499)..(499): n is a, c, t, g, unknown, or other
  misc_feature (504)..(504): n is a, c, t, g, unknown, or other
  misc_feature (525)..(525): n is a, c, t, g, unknown, or other
  misc_feature (581)..(581): n is a, c, t, g, unknown, or other
  misc_feature (659)..(659): n is a, c, t, g, unknown, or other
tggagctccccgcggtggcggccgctctagaactagtggatcccccgggctgcaggaattcgcacgagaccattacctagaacatcctaaatcgaaaaatacggctgaagggagtcgcttcgccgccgcgttcgaggcgttccctcgtcgcgctcgcgccgtcgaccttcaccgcttcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacnatggaggacgaggagatggagaagaaggtgcagcagtacttgcagcgcaagggtttccgcctcactgagcttgcgctccaggaggagtgcaaccgcctctccacctccgccatcntcgangttgcgcttgcacggtctgancatgatccagcgagatactacgatggatatagcagattaagaacatgggcatacgnttctcttttgatcatatagcacgatttacttcgcgtcctttatccagttttcatcccatagcttcatggatctagtgncagaaggacatatgcaagaaagctcggtcattttt

SEQ ID NO: 34660 - protein, 71 aa, Zea mays
  misc_feature: Ceres CLONE 1413333-F
  misc_feature (39)..(39): Xaa is any aa, unknown, or other
  misc_feature (40)..(40): Xaa is any aa, unknown, or other
  misc_feature (47)..(47): Xaa is any aa, unknown, or other
  misc_feature (66)..(66): Xaa is any aa, unknown, or other
MEDEEMEKKVQQYLQRKGFRLTELALQEECNRLSTSAIXXVALARSXHDPARYYDGYSRLRTWAYXSLLII

SEQ ID NO: 34661 - DNA, 709 bp, Zea mays
  misc_feature: Ceres CLONE 1413334-F
  misc_feature: Encodes the peptide sequence at SEQ ID NO. 34662
tggagctccccgcggtggcggccgctctagaactagtggatcccccgggctgcaggaattcgcacgagaccattacctagaacatcctaatcgaaaactctcgatccgtatacctctctcaccctagccgtctcctgtaagtttttcagctcactaatctgtgccatggtgagtgcgacttagaccttcgcatttcaggctgagatcaaccagctgctctcactcatcatcaacaccttctactccgacgaggagatcttcctccgcgagcttatctccaactcttccgatgtgctggacaagatcaggttctagagtctcactgacaatagcatgctcaatgcgcagtctgagcttttcatcctccttgtccgacacaaggtcacgaacacgctctccatcatcgacggtgacatcggaatgaccaagtccgaccttgtcaacaatctcggtaccatcgacgggaccgggaccaaggagatcatgtaagcccttgctgccgatgctgatgtgtccatgattggccagttcggcgtcattttctactctgcctacctcgtcgccttatagagttgtcgtgaccacctagcacaacgatgacgagcagtgacgtgtggtactcccaaatggggcgactcgttcactgtttactcgtggacacagtcaggtgagcagctttgtgcaggggcacttaagatcacactgcttc

SEQ ID NO: 34662 - protein, 51 aa, Zea mays
  misc_feature: Ceres CLONE 1413334-F
MLNAQSELFILLVRHKVTNTLSIIDGDIGMTKSDLVNNLGTIDGTGTKEIM

SEQ ID NO: 34663 - DNA, 712 bp, Zea mays
  misc_feature: Ceres CLONE 1413337-F
  misc_feature: Translation starting site: 277
  misc_feature (538)..(538): n is a, c, t, g, unknown, or other
  misc_feature (569)..(569): n is a, c, t, g, unknown, or other
ggagctccccgcggtggcggccgctctagaactagtggatcccccgggctgcaggaattcgcacgagaccattacctagaacatcctaatcgaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtatcgaagaagtcggggcttctcttcgagcggcggctcatcgagcgctacattgaggaccatggcaagtgccccatcaccaaggatgagcttactatggatgatatcgtgccggtcaataccaacaaggtcgtgaagccccagcctttgcaggctgcaagcattcccagactccttggggatttttcagaacgagtgggatgctctcatgctttctaanttttgcttggagcagcagctacacacagcangacaagaacttagtcatgcactctaccagcatgacgctggcctgcccgtgtatagcccaggtgaaagagggaagagatgaggctagagcacttttggctcaggctgagagacgattccagcatcagttgcaggagctgctccc

SEQ ID NO: 34664 - DNA, 684 bp, Zea mays
  misc_feature: Ceres CLONE 1413340-F
  misc_feature: Encodes the peptide sequence at SEQ ID NO. 34665
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (249)..(249): n is a, c, t, g, unknown, or other
  misc_feature (280)..(280): n is a, c, t, g, unknown, or other
  misc_feature (290)..(290): n is a, c, t, g, unknown, or other
  misc_feature (291)..(291): n is a, c, t, g, unknown, or other
  misc_feature (297)..(297): n is a, c, t, g, unknown, or other
  misc_feature (300)..(300): n is a, c, t, g, unknown, or other
  misc_feature (302)..(302): n is a, c, t, g, unknown, or other
  misc_feature (304)..(304): n is a, c, t, g, unknown, or other
tggagctccccgcggtggcggccgctctagaatagtggatcccccgggctgcaggaattcgcacgagaccattacctagaacatcctaatcgaaaagtacacaagctcgtctcgcaccagaaacccgcgaatcaatcccgaatcccgatcgaccggcggcgcgggaggcgatgccggacaaggcggtggacgacgtcatggaggccgcggtgnnngcccacttcagcggcctccgcctcgaggcgctgncgctctccacctctgcgccctcttcccatanctcctccccnngcgcgnggngnanacgcactccaacggagccgtctacgccaacggcaccaccgagcttccctctcctggcgctgccgggcaggcattcgtcatcgggggtttctggagggacggcctccgggaagacgacggtgtgcgacatgatcatccaggagctgcacgaccaccgtggcgtgctccgtaaccaggaattcgtttaccggggcccttactgctgaagagtctgcacacgcacaagaataaaattttggaacaccctggaggcatttgaaaccgaggcaacttctaaaaaggcgtgggggcagttgaaaatgggccccaaccctgaaaaatgttcccaaataaatgattttcaagaaagcttccgaccgggggtttttggaaaggttttag

SEQ ID NO: 34665 - protein, 112 aa, Zea mays
  misc_feature: Ceres CLONE 1413340-F
  misc_feature (15)..(15): Xaa is any aa, unknown, or other
  misc_feature (27)..(27): Xaa is any aa, unknown, or other
  misc_feature (37)..(37): Xaa is any aa, unknown, or other
  misc_feature (41)..(41): Xaa is any aa, unknown, or other
  misc_feature (43)..(43): Xaa is any aa, unknown, or other
  misc_feature (44)..(44): Xaa is any aa, unknown, or other
  misc_feature (45)..(45): Xaa is any aa, unknown, or other
MPDKAVDDVMEAAVXAHFSGLRLEALXLSTSAPSSHXSSPXAXXXRTPTEPSTPTAPPSFPLLALPGRHSSSGVSGGTASGKTTVCDMIIQELHDHRGVLRNQEFVYRGPYC

SEQ ID NO: 34666 - DNA, 681 bp, Zea mays
  misc_feature: Ceres CLONE 1413344-F
  misc_feature: Encodes the peptide sequence at SEQ ID NO. 34667
  misc_feature (338)..(338): n is a, c, t, g, unknown, or other
  misc_feature (342)..(342): n is a, c, t, g, unknown, or other
  misc_feature (407)..(407): n is a, c, t, g, unknown, or other
  misc_feature (470)..(470): n is a, c, t, g, unknown, or other
  misc_feature (473)..(473): n is a, c, t, g, unknown, or other
  misc_feature (485)..(485): n is a, c, t, g, unknown, or other
tccccgcggtggcggccgctctagaactagtggatcccccgggctgcaggaattcgcacgagaccattacctagaacatcctaatcaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccgggcctcccgggtgcccntggntgggaaccctgtccaggtgatcctgcagcgacggcccttcatgtacgtggtgcgcgacctccggnagaagtacgggcccatcttcaccatggcgatggggcagcgcaacctcatcgtggtcacctcgncgnagctcatccacnaagcgctgggtgaagcaaggccccatggtccggagccggcccaaggaaacccccaccgcctctcttcagggtgggaaggggaccgtaattcggggcctaaggcccctgggggggggttctgggccaaattccgggccgaaaatgggccccccaccgggaaaggtttccctgggacccggggagggccccgggaccc

SEQ ID NO: 34667 - protein, 99 aa, Zea mays
  misc_feature: Ceres CLONE 1413344-F
  misc_feature (9)..(9): Xaa is any aa, unknown, or other
  misc_feature (30)..(30): Xaa is any aa, unknown, or other
  misc_feature (31)..(31): Xaa is any aa, unknown, or other
  misc_feature (35)..(35): Xaa is any aa, unknown, or other
MYVVRDLRXKYGPIFTMAMGQRNLIVVTSXXLIHXALGEARPHGPEPAQGNPHRLSSGWEGDRNSGPKAPGGGFWAKFRAENGPPTGKGFPGTRGGPRD

SEQ ID NO: 34668 - DNA, 728 bp, Zea mays
  misc_feature: Ceres CLONE 1413348-F
  misc_feature: Translation starting site: 369
aaagctggagctccccgcggtggcggccgctctagaactagtggatcccccgggctgcaggaattcgcacgagaccattacctagaacatcctaatcgaaaaatcacccctgttctcgtggtattgtctcagtctactatagtggctgcctacggctcgcgctttcctcgcgttcgggaaggtcgtgtccacatgctctacatctagcgagacctgctccttacacgcgcaaatacacgagctgctctagctcatcatcatcaccttctactccaacaaggagatattcctcagggagctcatctccaactcctccgatgtcttgcacaagatcatgtttgagagtttgacggacaatagcaagctggatgcacgagcagagctgttcatcgcacatgtgtttcgacaaggcgaacaaccccttgagaatgatccaccgtgtcattggtatgaccaagtcacaccttgagaacaaccctgggaccattgcgcggttacgaaccaaggaattcatgcccgaaatagctgctcgagctgatctgtccatgagtggcgagctttgagcccgcgactactccggctactttgatgcagaacaggtcttccttcgaaccctaatccccagtgatgaaagagaaaaaccgggcgcaaaaccttaagtttgcgggtgccttccccggtcccccccgaatagcactgcgaatgaactttggtaggggagaacaaaa

SEQ ID NO: 34669 - DNA, 685 bp, Zea mays
  misc_feature: Ceres CLONE 1413350-F
  misc_feature: Encodes the peptide sequence at SEQ ID NO. 34670
  misc_feature (345)..(345): n is a, c, t, g, unknown, or other
aaagctggagctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaacgtctcgagcagctcgaggaccgcgntgtcggtaagacttgctttgaagatcttgatcacccacagagatttgctgaatttcgggtcactgtactttttccactgcacatgtcctttcgcagcatagtccgtgatgttagggaaaggtttggtagcttatcaagacgggagtcttgaggtccagaattctgggttgcctggtctgcctaaatctgttggatctgtgagtgacctgcgcgacagacctgaaataattgatcaaagcagggtggttggccctttcctcccgaattctttccaaatgaaatggacaaggtttaggaagggggaaaacaatttggccatcccggaaaaaatgttggttgc

SEQ ID NO: 34670 - protein, 77 aa, Zea mays
  misc_feature: Ceres CLONE 1413350-F
MLGKGLVAYQDGSLEVQNSGLPGLPKSVGSVSDLRDRPEIIDQSRVVGPFLPNSFQMKWTRFRKGENNLAIPEKMLV

SEQ ID NO: 34671 - DNA, 733 bp, Zea mays
  misc_feature: Ceres CLONE 1413356-F
  misc_feature: Encodes the peptide sequence at SEQ ID NO. 34672
  misc_feature (733)..(733): n is a, c, t, g, unknown, or other
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagccccgcgtcgtacggtttcgagcagccggcgccgattccgggcccctgccacacccgagcctccggcccccgggcacatccaagacgccgtctccgggccccggccacaccaaagccgccgccctccggccccgagccacaacccaagccctctgccagcggaaggaggaaaagggccgccgccccgcgtggttggacatcaacgggcgtcccgggggaaggttaaaccttggaagctttggcgaccttgcaaaagaattcggccccccggaaggggccagcgatgccccttgtgtcaggcggcggccccaagttacccgttgctttaactccccaggcaacgccgaccccccccgggcaaatgggcccaggttttttgatcccctcccggccccccccttaacgccaacccgcagggggaatgcgctattctgggtcggggccattttn

SEQ ID NO: 34672 - protein, 92 aa, Zea mays
  misc_feature: Ceres CLONE 1413356-F
MGAVTSTVAARFAFFPPSPASYGFEQPAPIPGPCHTRASGPRAHPRRRLRAPATPKPPPSGPEPQPKPSASGRRKRAAAPRGWTSTGVPGEG

SEQ ID NO: 34673 - DNA, 693 bp, Zea mays
  misc_feature: Ceres CLONE 1413359-F
  misc_feature: Encodes the peptide sequence at SEQ ID NO. 34674
  misc_feature (344)..(344): n is a, c, t, g, unknown, or other
  misc_feature (378)..(378): n is a, c, t, g, unknown, or other
  misc_feature (539)..(539): n is a, c, t, g, unknown, or other
  misc_feature (644)..(644): n is a, c, t, g, unknown, or other
  misc_feature (659)..(659): n is a, c, t, g, unknown, or other
ggagctccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggncatcgtcacctcactcggcggaggccctgcagcnggtggggatcgtgcggatctccggccccgatgccgtcgccgtcgccgaccgctgtttcccgcccagccgggaccaggagggcgtcgacgccgtgggcaacgcgcagccacttttgtgagtacggactcgcgctcgacgcggacggcagcgttattgacganggtttggttggtgcaatgctcctcccgaggtctacacgcgagaggatggtgtggagcttcagtgccatggcaacgatctctgctttgcgccgcgtgctcagggcntgctttggaagctgnaccagactttgctgaaccctgtgagttcccccct

SEQ ID NO: 34674 - protein, 197 aa, Zea mays
  misc_feature: Ceres CLONE 1413359-F
  misc_feature (81)..(81): Xaa is any aa, unknown, or other
  misc_feature (146)..(146): Xaa is any aa, unknown, or other
  misc_feature (181)..(181): Xaa is any aa, unknown, or other
  misc_feature (186)..(186): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAXIVTSLGGGPAAGGDRADLRPRCRRRRRPLFPAQPGPGGRRRRGQRAATFVSTDSRSTRTAALLTXVWLVQCSSRGLHARGWCGASVPWQRSLLCAACSGXALEAXPDFAEPCEFPP

SEQ ID NO: 34675 - DNA, 717 bp, Zea mays
  misc_feature: Ceres CLONE 1413360-F
  misc_feature: Encodes the peptide sequence at SEQ ID NO. 34676
  misc_feature (339)..(339): n is a, c, t, g, unknown, or other
  misc_feature (582)..(582): n is a, c, t, g, unknown, or other
  misc_feature (583)..(583): n is a, c, t, g, unknown, or other
  misc_feature (674)..(674): n is a, c, t, g, unknown, or other
aagctggagctccccgcggtggcggccgctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcacagctcttatgaactcgancagctccaagatacagcagcttcaggaggcatttgctgagcttgagagccagagcacggtttcccatgacctcaagtggaagcagcttgaagaccactttcgtggtcttgaacagtccctcaagaaaaagtttgacgagctaaaagagcaggagaaaggagtccaggagactgtcgcaaaatcagagcagattctggagcagcgggaggcagctgttgtggcaaaggaactgacctcttgaannaagtgcaggagaagaggaagctgcattagctatgatctttagcaaggcaggcttttctttactggtctacccatcacccatgggacaggcngctgatatcttggtgtcagtggccaaaccggttctggaggagg

SEQ ID NO: 34676 - protein, 93 aa, Zea mays
  misc_feature: Ceres CLONE 1413360-F
  misc_feature (14)..(14): Xaa is any aa, unknown, or other
MSDMESVTALMNSXSSKIQQLQEAFAELESQSTVSHDLKWKQLEDHFRGLEQSLKKKFDELKEQEKGVQETVAKSEQILEQREAAVVAKELTS

SEQ ID NO: 34677 - DNA, 692 bp, Zea mays
  misc_feature: Ceres CLONE 1413363-F
  misc_feature: Translation starting site: 123
  misc_feature: SWISSPROT Homolog: EC 6.1.1.14 Glycine--tRNA ligase
  misc_feature (468)..(468): n is a, c, t, g, unknown, or other
tccccgcggtggcggccgctctagaactagtggatcccccgggctgcaggaattcgcacgagaccattacctagaacatcctatcgaaaaacacgtcagcccctcgatccgcttcccatctgatgctcgtgctccgccgcgtctccttcctcctctcgtcgccctcccctcgcgcaccgctcgcaaaacctctcctgctcctacgcccgccccaaaccctagccccgacagcgcggcagctcgtggctatggccgcgtcagtcccgtcggcgggtggggcggggacgatgagccgcgacgcgttccgcgcggccgtgaccaacacgctggagcgccggctcttcttcgtgccctctttcaagatctacgggcggcgtcgcggggctctacgactacggacccccaggttgcgctgtcaaagctaacgtcctcgcattctggcgccagcattttgtattggaggaaggnatgcttgaggttgactgtccatgtgtgacgccagaagttgtcttgaaagctctggacatgttgataaatttacagacttaatggttaaagatgaaaagacaggcactgctaccgtgcggatcatttgctgaaggacttctgtaagggatagcttgagaagatacacattgtcacagagatggagagaaaacaatagagtcttggtatcctggatgactcctgaa

SEQ ID NO: 34678 - DNA, 722 bp, Zea mays
  misc_feature: Ceres CLONE 1413367-F
  misc_feature: Encodes the peptide sequence at SEQ ID NO. 34679
  misc_feature (344)..(344): n is a, c, t, g, unknown, or other
  misc_feature (345)..(345): n is a, c, t, g, unknown, or other
  misc_feature (353)..(353): n is a, c, t, g, unknown, or other
  misc_feature (354)..(354): n is a, c, t, g, unknown, or other
  misc_feature (360)..(360): n is a, c, t, g, unknown, or other
  misc_feature (412)..(412): n is a, c, t, g, unknown, or other
ccccgcggtggcggccgctctagaactagtggatcccccgggctgcaggaattcgcacgagaccattacctagaacattctaatcgaaaagaagggaaaagcattccaacgctgcatctgcactgcacggtacttcctcctcctcatcctcctctatctctaagaatttaaaagagaagaagggggaagtcctcgactgctcgttccataaaccctaacctcgttggattcgcggtaaaaatcctcccaattcggaaccctccgatgttccagctacctgcgggagctgagccgtgctcggtttggcgaaattttgcacccctcttgtgctacgaccacccggnntcagctgnntctcgnaagggatcagtcttcaacggtgctctccgggcgcaggatcagtttttgtccngggaaaggaacgggctccttggtgggggcaagcccagtttcgagctcaatttggcgggcctgagaaggaatcccgacctgcggggccggggcccggggcctcaacttagcccggcaaaaccaacccccaattccggcctttgggggggcccaccctttccgggaaatccggggggggtgttccctctctcttgggggaaaaaagggtgggggggtgaggtttccccaggggtaaatacccccccccccggggggggagggaaacaatttagaggggggggggtattctccccccctttcacaaaagaggg

SEQ ID NO: 34679 - protein, 152 aa, Zea mays
  misc_feature: Ceres CLONE 1413367-F
  misc_feature (27)..(27): Xaa is any aa, unknown, or other
  misc_feature (30)..(30): Xaa is any aa, unknown, or other
  misc_feature (50)..(50): Xaa is any aa, unknown, or other
MFQLPAGAEPCSVWRNFAPLLCYDHPXSAXSRKGSVFNGALRAQDQFLSXERNGLLGGGKPSFELNLAGLRRNPDLRGRGPGPQLSPAKPTPNSGLWGGPPFPGNPGGVFPLSWGKKGWGGEVSPGVNTPPPGGGGKQFRGGGVFSPPFTKE

SEQ ID NO: 34680 - DNA, 684 bp, Zea mays
  misc_feature: Ceres CLONE 1413369-F
  misc_feature: Translation starting site: 221
  misc_feature: SWISSPROT Homolog: EC 2.3.1.61 Dihydrolipoyllysine-residue succinyltransferase
  misc_feature (562)..(562): n is a, c, t, g, unknown, or other
  misc_feature (597)..(597): n is a, c, t, g, unknown, or other
  misc_feature (627)..(627): n is a, c, t, g, unknown, or other
  misc_feature (666)..(666): n is a, c, t, g, unknown, or other
tggagctccccgcggtggcggccgctctagaactagtggatcccccgggctgcaggaattcgcacgagaccattacctagaacatcctaatcgaaaaattccagtcttttcagaacgagattgcatcgaggaaactacagaaaagggaccaaatcgaatccgtggtgcactgcccctccccctccctcacaagccgccgccgccgtgaggactccggcgaatggcgtcccgcgtcgcctcgggcctcctccgccgccgcgccgtcgccactctagggctactaaggagtcatacacatgtcagaaactacagcagtcaactttcagctttgattccagctacttctcaatgctcaaatctgacaagaagacgctattacttacctaatccatctctgtaccaagtttggagtaggtcatttgcctcagacagcggagaacagttcgaggctgttgtgcccttcatgggtgaatctgtaactgatggaactcttgctaacttcttaaagaagctggagacagagtcgaggccgatgaacccatagcgcagattgaaactgatnaggtcactatagatgtcgcaagtcctgaagctggntgtattgaacagctcattgctagtgaaggncgacacagtactcccggcactaaggtgcaatcatatccnagtctgctcacctgctga

SEQ ID NO: 34681 - DNA, 699 bp, Zea mays
  misc_feature: Ceres CLONE 1413373-F
  misc_feature: Encodes the peptide sequence at SEQ ID NO. 34682
  misc_feature (570)..(570): n is a, c, t, g, unknown, or other
tccccgcggtggcggccgctctagaactagtggatcccccgggctgcaggaattcgcacgagaccattacctagaacatcctaatcgaaaaatttcccaccttcccaaacgccacttaaaagagaaaggagagcatcgcagtggcacacgcgcaatggaaggctcgccggtgacgcgcctcccggaggctaactccctccccgacggcttcgttcccgactccgagagccctggcacggacgcgacgtttcccttctccgcgcccatcgttgatgatgcgctcaactccgatatccccgccgcgaccaacccaggcggcgaggaaaccctaaacgatccccccctccctgcgtccagcgccgaagatgcctcctcggccgccgctgctgaagccttgggcacactttctctggacgctgccgccgagccagaacgcgctctagaggagaacggacccaccggcgctgcaagaggtgaagcatccttgaagaattgtgcatcagagctagtgggcgctccaactgctcaaaaagggagcgttgagccgaaacgtaaggttgtgaaacgtancaagctggagaaagacagagagttgtttgaactggcccagcataacataaaggttgtgcagaaaggatgcacccattgaagttaaagaaaacctagatctctttgtagggagtttcagcgtcaaaacag

SEQ ID NO: 34682 - protein, 164 aa, Zea mays
  misc_feature: Ceres CLONE 1413373-F
  misc_feature (139)..(139): Xaa is any aa, unknown, or other
MEGSPVTRLPEANSLPDGFVPDSESPGTDATFPFSAPIVDDALNSDIPAATNPGGEETLNDPPLPASSAEDASSAAAAEALGTLSLDAAAEPERALEENGPTGAARGEASLKNCASELVGAPTAQKGSVEPKRKVVKRXKLEKDRELFELAQHNIKVVQKGCTH

SEQ ID NO: 34683 - DNA, 699 bp, Zea mays
  misc_feature: Ceres CLONE 1413376-F
  misc_feature: Translation starting site: 215
  misc_feature: Pfam Name: Helicase_C Pfam Description: Helicase conserved C-terminal domain
  misc_feature (307)..(307): n is a, c, t, g, unknown, or other
  misc_feature (331)..(331): n is a, c, t, g, unknown, or other
  misc_feature (432)..(432): n is a, c, t, g, unknown, or other
  misc_feature (435)..(435): n is a, c, t, g, unknown, or other
aaagctggagctccccgcggtggcggccgctctagaactagtggatcccccgggctgcaggaattcgcacgagaccattacctagaacatcctaatcgaaaacaagagatgaacctgattatgaggtgtacttgcacagaattggcagagctgggcgctttggccggaaagtgctgtgttcaacttgctgtgtggtcaaaccgataatgttgtgatgaagaagatcgaggactatttccagcacagtgtgcctgaggttcggaattggcaacgtgaagaagattttgaggctgctctcaaggatgcnagtttactttaaagtaaccacggnaacttgtggtgagcagcgctctccggctcgggacaattgaccggtgattttttttgctgagcctgctgcacaacgttattgtgctctttctgctctcctgntgncagcactgattttcaccggtgatttttttttcgctgaacgtgctgcacagcgttgctgtgctcttatgttcatcctgttgtcagcactgattgttttgcagcagagttgtggatttatgtaaaagactagaacagctattgtgttgtgagctttatatgaagcagagggttcgttagaaggtgtcatttgccattatgcttgaagcgcagttacgagcattacattttgaactgtaaatctttttactagagagtagacttttt

SEQ ID NO: 34684 - DNA, 713 bp, Zea mays
  misc_feature: Ceres CLONE 1413377-F
  misc_feature: Translation starting site: 247
  misc_feature (338)..(338): n is a, c, t, g, unknown, or other
  misc_feature (339)..(339): n is a, c, t, g, unknown, or other
  misc_feature (355)..(355): n is a, c, t, g, unknown, or other
  misc_feature (381)..(381): n is a, c, t, g, unknown, or other
  misc_feature (440)..(440): n is a, c, t, g, unknown, or other
  misc_feature (452)..(452): n is a, c, t, g, unknown, or other
  misc_feature (539)..(539): n is a, c, t, g, unknown, or other
ggagctccccgcggtggcggccgctctagaatagtggatcccccgggctgcaggaattcgcacgagaccattacctagaacatcctaatcgaaaagttcctttcttccccactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgnntggatggtgagcgtgntgtacagccagtcggatctgctgcgnaaggaggtcttcctcgtcgagaccatgggacacgccctcagctccagggagtccatggncgcactcagggncgtctacttcctccgacccctccgctacacgtccagaagctccgcaggcaccctcgcatggcgcgcttcgccgagtaccacctattncttctcagtatagtggaaggtccgcagaatcaaatacttgctgactcggatgaacaggaagttgggcaacaagttcaagagttctatgctgatttttgggcattgacccatacatttccctctcaacatacaaataacacatggattgctcccaacggggtcgaccctcctgga

SEQ ID NO: 34685 - DNA, 720 bp, Zea mays
  misc_feature: Ceres CLONE 1413381-F
  misc_feature (338)..(338): n is a, c, t, g, unknown, or other
  misc_feature (436)..(436): n is a, c, t, g, unknown, or other
aaagctggagctccccgcggtggcggccgctctagaactagtggatcccccgggctgcaggaattcgcacgagaccattacctagaacatcctaatcgaaaaaaaatctggaatcctttcacgccgccactctcccctttttccttctctcttcgtcgttgtggctcctgccttcctgcctcggcgcatcgactcgcggagagggacagcacagcgcctcttccccatcctttctccattcccagatcgaaggtccatgtgagtattgcgtgaatcttgcaagttttggttccgtcgcggtttctggttttcttgctgattggttccctgaatctttngcaagaccctgaaatcgagagatgtaggaaagttagaacacgagtcaggtaccaagcaccgagtatttgcaagatccgcaccggttcccagctagaantgttccacctattgatcctggataaaaccggttcggagttttttccctccgtgctgaaacttctccataatgttggggggcagaaaaaaccatccttttgcatctgatagacactggcttttgggaaaaaaaaaatttagttggacatacaaaacaaaaaaagggggaattttttccaagtttataaaaaaaaaggttttgggggccccgttaaaaaaaaggggaaagtttttaaccgggtagtgttttgtataaggacccccaggggccccccccggggtggt

SEQ ID NO: 34686 - DNA, 731 bp, Zea mays
  misc_feature: Ceres CLONE 1413383-F
  misc_feature: Encodes the peptide sequence at SEQ ID NO. 34687
  misc_feature (297)..(297): n is a, c, t, g, unknown, or other
  misc_feature (320)..(320): n is a, c, t, g, unknown, or other
  misc_feature (351)..(351): n is a, c, t, g, unknown, or other
  misc_feature (353)..(353): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcagccccgagccgtcgcgcggtcgcctccacatctcgtcgntcttcaaggtctatggcctccgnccgtcttgaacaggggcacacactgttcacngntgcccactacggcaaaaacgagtcttcgtgggggttcgaaggttgaagaaaatcatcagggcggggaggggagggccgcgtcccccccaaccggaggggaggggggaaaatggcggccggggacaggcccactttgaagggggttttcccccgtggttttttttgccatttggggccttaaaaaaacaaaaaaaaactttttccggaaagaaaaaaaccccctttgggagggaaaaatttttcgccaaggcccccacaacaaggagggggggnaagggggttttgccccctctaaaaaaaaatattttggggcccccaaaccggaaaaaaaaaggtttttttaaaaaaaaaaaacccctttataacaagagggggggg

SEQ ID NO: 34687 - protein, 29 aa, Zea mays
  misc_feature: Ceres CLONE 1413383-F
  misc_feature (4)..(4): Xaa is any aa, unknown, or other
  misc_feature (15)..(15): Xaa is any aa, unknown, or other
MASXRLEQGHTLFTXAHYGKNESSWGFEG

SEQ ID NO: 34688 - DNA, 687 bp, Zea mays
  misc_feature: Ceres CLONE 1413386-F
  misc_feature: Encodes the peptide sequence at SEQ ID NO. 34689
  misc_feature (273)..(273): n is a, c, t, g, unknown, or other
  misc_feature (368)..(368): n is a, c, t, g, unknown, or other
  misc_feature (469)..(469): n is a, c, t, g, unknown, or other
  misc_feature (530)..(530): n is a, c, t, g, unknown, or other
  misc_feature (555)..(555): n is a, c, t, g, unknown, or other
  misc_feature (559)..(559): n is a, c, t, g, unknown, or other
tggagctccccgcggtggcggccgctctagaactagtggatcccccgggctgcaggaattcgcacgagaccattacctagaacatcctaatcgaaaaagctagccaagctataccactagaaccagagcacaactcaaagcaatgccgccgcctcctcctcctccgccccactcccacgcttcccatcccgcgccgcatggacgcgagcagcactagcgcgggggcacacagcacggcgagcgggcgggggcgcgacgatggacctgggcggntcggtggtgatggacgcgggcgcctcggagctgggcctgctcggcggcggatctagcaggctgctcaagcacggggcggggcccaatgcggcggngggagacgacgacgtgtggggcggcggcagggccaagcagccccagacaggaacagcgcccgtcgtcgccggaggacgtggcggctgccaacaaagcgganggcgcagccgatcctgctgggctcgtgcagccccggccacggaggggaagcagatgctcantttctcgtaccgccgccgacggcgnccgnggcctcgtgcccctccttccaccgctgcggttgatggcagccgggtccatgcccgttgtactacggggaccccggccttcttgctcaggattgagctcgggggatcttgagccccagcatggaggggg

SEQ ID NO: 34689 - protein, 136 aa, Zea mays
  misc_feature: Ceres CLONE 1413386-F
  misc_feature (37)..(37): Xaa is any aa, unknown, or other
  misc_feature (71)..(71): Xaa is any aa, unknown, or other
  misc_feature (91)..(91): Xaa is any aa, unknown, or other
  misc_feature (101)..(101): Xaa is any aa, unknown, or other
MDLGGSVVMDAGASELGLLGGGSSRLLKHGAGPNAAXGDDDVWGGGRAKQPQTGTAPVVAGGRGGCQQSGXRSRSCWARAAPATEGKQMLXFSYRRRRRPXPRAPPSTAAVDGSRVHARCTTGTPAFLLRIELGGS

SEQ ID NO: 34690 - DNA, 634 bp, Zea mays
  misc_feature: Ceres CLONE 1413387-F
  misc_feature: Encodes the peptide sequence at SEQ ID NO. 34691
  misc_feature (300)..(300): n is a, c, t, g, unknown, or other
  misc_feature (494)..(494): n is a, c, t, g, unknown, or other
  misc_feature (495)..(495): n is a, c, t, g, unknown, or other
  misc_feature (517)..(517): n is a, c, t, g, unknown, or other
tggagctccccgcggtggcggccgctctagaactagtggatcccccgggctccaggaattcgcacgagaccattacctagaacatcctaatcgaaaaatcgatctattctcgtctgaagcaattcgcccctgtcgtgagcagaatcctacagctcgtattcgcctcatctcgcagcagcagcagaagaacaagggtatggcgaaggatgggggtcccgactggaacggcctgctcaagtggagcctcgcccacggcgacagcaccaacccgccgcgtgctctcagcgaggaagacagaanatggttcatggatgctatgcaagccaacacggtagatgttgtgaagaggatgaaggagatcactcaggtcatgaaaacaccagaagatgtcttgcagtctcagggtgtgaccccggagacattgaagatatgttggatgagctacaggagcatgttgaatccattgacatggcaaatgatctacattctatggnnggggctggatcctctacttagntactggaaaaattcaaatgctggcatccgagcaagggcagcaaaagttggtaataccattggggcaaaatatccccagaggccgccactttggcatgggattccagtgactaagggc

SEQ ID NO: 34691 - protein, 146 aa, Zea mays
  misc_feature: Ceres CLONE 1413387-F
  misc_feature (35)..(35): Xaa is any aa, unknown, or other
  misc_feature (100)..(100): Xaa is any aa, unknown, or other
  misc_feature (107)..(107): Xaa is any aa, unknown, or other
MAKDGGPDWNGLLKWSLAHGDSTNPPRALSEEDRXWFMDAMQANTVDVVKRMKEITQVMKTPEDVLQSQGVTPETLKICWMSYRSMLNPLTWQMIYILWXGLDPLLXYWKNSNAGIRARAAKVGNTIGAKYPQRPPLWHGIPVTKG

SEQ ID NO: 34692 - DNA, 840 bp, Zea mays
  misc_feature: Ceres CLONE 1413389-F
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (820)..(820): n is a, c, t, g, unknown, or other
gtaatcctgcaacactccaccacgccgccaccanncnnnnngggggcnnnccaaagctggcactccccgcggtggcggccgctctataatagtggatcccccgggctgcaggaattcgcacgagaccattacctagaacatcctaatcgaaaaaatcgacccagccatctcctcaccctcgatcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgttgctggtcgtaccatccacggccggggcggaggacggagtggtcgaaccggcacccgcaaggaggacctgcggtggtgccagcaggcgtgcgagtggtagtacggaacggacctcccgtcggaaggaaggaatgcgagaacgtggcgcccgtgtggcgggtaccaacaaagcctgaaccccggtcgcaggacacggcgtacagcgggcggtgggacagccctaaccgccctccccggcctcccagccaagggggtcgaggtgcccgggtggtccagggtgcactgggcgccggtccccccaagggcccaaggcccggggggtaagaacccaagcaaactgccaaggaagcgcaaatgggtcgactcgccagcgaacacgcggtccgcaacccccacggtaacccaaaagttaacccggcggggcctctaatcccgcccgccgcggcccccccgttataccgacgggaaaggctgttccacccaccctcccccgcaggngtgcgccttggcggggtaaa

SEQ ID NO: 34693 - DNA, 709 bp, Zea mays
  misc_feature: Ceres CLONE 1413390-F
  misc_feature: Encodes the peptide sequence at SEQ ID NO. 34694
  misc_feature (495)..(495): n is a, c, t, g, unknown, or other
  misc_feature (499)..(499): n is a, c, t, g, unknown, or other
  misc_feature (500)..(500): n is a, c, t, g, unknown, or other
  misc_feature (519)..(519): n is a, c, t, g, unknown, or other
  misc_feature (551)..(551): n is a, c, t, g, unknown, or other
  misc_feature (554)..(554): n is a, c, t, g, unknown, or other
  misc_feature (593)..(593): n is a, c, t, g, unknown, or other
aaagctggagctccccgcggtggcggccgctctagaactagtggatcccccgggctgcaggaattcgcacgagaccattacctagaacatcctaatcgaaaactcgccgcaacgaattcccggtctccaaccagccggccagccaccgcagacgacccctagttccgcgtccccgacccgaaccctcgagttcgcacgggctccggccagattcgcgcggtctaagcttcgaatcggcgcatggaggcagcagtagccgcggcactcaagtcgcccaccgccgcacgtccctcgtggcggcccgcggccccgggcgccacctcgctcccctttgaccggaggcgcagctttgccttcggctccatcaagggtctcgggcggcagcagctcacctctaggactaggaggcgaagcagtgtggtcagggcctcctggtcccccctcgagtctctgccacccgtctcgtcgatggcgccgctcaggatggaatcgccngcgnngcagctactctcccagatncttcacacgcacccgcacctactggctggcgncgncgagcagcagttcgagctgctccagacccgacgcgaggnagagaggataaggagtaggagagcgatgctgcgaacagctggctcccgaaggtgtcgacctcatgctgtaacggcggatttgctcagtaaaggaaaaggaccgaaggagactttga

SEQ ID NO: 34694 - protein, 80 aa, Zea mays
  misc_feature: Ceres CLONE 1413390-F
  misc_feature (11)..(11): Xaa is any aa, unknown, or other
  misc_feature (17)..(17): Xaa is any aa, unknown, or other
  misc_feature (28)..(28): Xaa is any aa, unknown, or other
  misc_feature (29)..(29): Xaa is any aa, unknown, or other
  misc_feature (42)..(42): Xaa is any aa, unknown, or other
MAPLRMESPAXQLLSQXLHTHPHLLAGXXEQQFELLQTRREXERIRSRRAMLRTAGSRRCRPHAVTADLLSKGKGPKETL

SEQ ID NO: 34695 - DNA, 702 bp, Zea mays
  misc_feature: Ceres CLONE 1413392-F
  misc_feature (1)..(1): n is a, c, t, g, unknown, or other
  misc_feature (400)..(400): n is a, c, t, g, unknown, or other
  misc_feature (478)..(478): n is a, c, t, g, unknown, or other
  misc_feature (483)..(483): n is a, c, t, g, unknown, or other
  misc_feature (509)..(509): n is a, c, t, g, unknown, or other
  misc_feature (510)..(510): n is a, c, t, g, unknown, or other
  misc_feature (520)..(520): n is a, c, t, g, unknown, or other
naaagctggagctccccgcggtggcggccgctctagaactagtggatcccccgggctgcaggaattcgcacgagaccattacctagaacatcctaatcgaaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttccgtgcggacgtcttcactctacctccagactggcggctgccatttccccccctcttcttgctgttttttttggngggggtggggggggtggaaatctgcggtggagtcttgccgtcgctcgctgtaaacgtagagctctctctctctcttgncgagnaatcctgggtcttgctccattttcgnngtagggctgncgtgtgagtggcagggttacgtgtaagatgtgaaaacagttcctgagcagctgcccccggagtcgtcggcctcggggactcggacattgcagcagggcgccgcatacgggcacgacaggtgcggagcatcccgcgggccgccccgggcctcgcattggggatggcatcggcgtcttccctcg

SEQ ID NO: 34696 - DNA, 668 bp, Zea mays
  misc_feature: Ceres CLONE 1413394-F
  misc_feature: Encodes the peptide sequence at SEQ ID NO. 34697
agagctggagctccccgcggtggcggccgctctatacactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcggccaccgcctttcacgccgttgacgaggcgaagcggcggctgaaggcggcggggttcgtgcagctgtcggagcgggaggagtgggcgggtctcgagcccgggcgcaagtacttcttcacacgcaaccactccactattgtcgcttttgccatcggcgcaaaatacgttgctgggaatgggttccacatcatcggtgcacacactggacagcccttgcctgaagctcaaggctggctccagaggaaccaaaggagggtaccctggagggtggggtccaaacgaagg

SEQ ID NO: 34697 - protein, 113 aa, Zea mays
  misc_feature: Ceres CLONE 1413394-F
  misc_feature: SWISSPROT Homolog: EC 3.4.11.21 Aspartyl aminopeptidase
MATVAPVVSDLVDFLNASATAFHAVDEAKRRLKAAGFVQLSEREEWAGLEPGRKYFFTRNHSTIVAFAIGAKYVAGNGFHIIGAHTGQPLPEAQGWLQRNQRRVPWRVGSKRR

SEQ ID NO: 34698 - DNA, 698 bp, Zea mays
  misc_feature: Ceres CLONE 1413400-F
  misc_feature: Encodes the peptide sequence at SEQ ID NO. 34699
agagctggagctccccgcggtggcggccgctctagaactagtggatcccccgggctgcaggaattcgcacgagaccattacctagaacatcctaatcaaaataccccggatccataatactctgttccactccccacatcccactcccatctctcccgtttctctacacttcctgagccagatgggggcggcaccctgctctaccaccttctccggcgacgtgtggccggacctgctcctggactccgccagggatgtgccgcacatccaccgcctgatacaccagatggtcgagttcgagctcctcaccgacctcttcgccgccaccgaagagatggtcacgtccacgttcttcccctcgccgacgccgccgcgcttcacctccttcacagccctcatcctcgacctatccccctcccccgtcgtgctcgatccctcgtgcaccatctcctcccgtcgcctcgacctctccgcgaccccgctcgcgtaccccaggtggcggcgccttctcctccccgaggggaggtgctagaggcacaggacgcgttcatgatctgtgttcccaacaactccagcttgcctctccaggccaagggatgaacgtggagggacctctttcctgcagcgacgccctaggctgccgcccccgggcctctgaccggcatgatggctgtcccgcacgtccccccattatgggg

SEQ ID NO: 34699 - protein, 116 aa, Zea mays
  misc_feature: Ceres CLONE 1413400-F
MGAAPCSTTFSGDVWPDLLLDSARDVPHIHRLIHQMVEFELLTDLFAATEEMVTSTFFPSPTPPRFTSFTALILDLSPSPVVLDPSCTISSRRLDLSATPLAYPRWRRLLLPEGRC

SEQ ID NO: 34700 - DNA, 734 bp, Zea mays
  misc_feature: Ceres CLONE 1413401-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
nnncccccccccccccccnnnntntnccnnananncggggcnnnttttcaaactggtactccccgcggtggcggccgctctagaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacgggcaatggcggccgtggcaggcccactctgcacgtgggctcgtcgccgcgggcttgtctgcggtttgcgacgcagaagagtacaagcagaagcattgcctgcccggcggaaacggcgctgggggcggcgtcatgctcggcctgcgccgacgtgctccgggccgcggcgtcgcggatttggccggcctctgggaatggtaatggcctggtgcccttaccaagctgaaaagaaggggcatttgaaaa

SEQ ID NO: 34701 - DNA, 735 bp, Zea mays
  misc_feature: Ceres CLONE 1413403-F
  misc_feature: Encodes the peptide sequence at SEQ ID NO. 34702
cagagctggagctccccgcggtggcggccgctctagaactagtggatcccccgggctgcaggaattcgcacgagaccattacctagaacatcctaatcgaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactacctcaaggacgcggtgctggacggcggcatcccgttcaacaaggcgtacgggatgacggcgttcgagtaccacggcacggacgcgcgcttcaaccgcgtggtcaacgagggcatgaagaaccact

SEQ ID NO: 34702 - protein, 184 aa, Zea mays
  misc_feature: Ceres CLONE 1413403-F
  misc_feature (31)..(87): Pfam Name: Dimerisation Pfam Description: Dimerisation domain
  misc_feature: SWISSPROT Homolog: EC 2.1.1.68 Caffeate O-methyltransferase
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVVNEGMKNH

SEQ ID NO: 34703 - DNA, 600 bp, Zea mays
  misc_feature: Ceres CLONE 1413404-F
  misc_feature: Encodes the peptide sequence at SEQ ID NO. 34704
  misc_feature (244)..(244): n is a, c, t, g, unknown, or other
  misc_feature (502)..(502): n is a, c, t, g, unknown, or other
gctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccacaaggagatcttcctccgcngagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaagggagtcatgggagcccttgctgccggcgctgatgtgtccatgattggncagttcggcggtcggttctactctggctacctcgtcgccgatagagttgtcgtgaccacaagcacacgatgacaagcagtacgggggggatccccagg

SEQ ID NO: 34704 - protein, 143 aa, Zea mays
  misc_feature: Ceres CLONE 1413404-F
MASETETFAFQAEINQLLSLIINTFYSTRRSSSAELISNSSDALDKIRFESLTDKSKLDAQPELFIHLVPDKATNTLSIIDSGIGMTKSDLVNNLGTIARSGTKGVMGALAAGADVSMIGQFGGRFYSGYLVADRVVVTTSTR

SEQ ID NO: 34705 - DNA, 674 bp, Zea mays
  misc_feature: Ceres CLONE 1413405-F
  misc_feature: Encodes the peptide sequence at SEQ ID NO. 34706
  misc_feature (262)..(262): n is a, c, t, g, unknown, or other
  misc_feature (366)..(366): n is a, c, t, g, unknown, or other
  misc_feature (369)..(369): n is a, c, t, g, unknown, or other
aaagctggagctccccgcggtggcggccgctctagaactagtggatcccccgggctgcaggaattcgcacgagaccattacctagaacatcctaatcgaaaaatcgaccaattcatccaatagtggatactttgtctccaagtctcaaaacccaattcgacccacttggaaccggccttgttccccgttggatccagcctaataaaattccccattccaacacacacagatctcgatcccggagtggcgacgaatctcgcgngcggaggtggtgcgcgacagagcggtgtcgactcgacgactcgcagccacggtggatacgcacagcagcacggcgcactccacgacgtcatatttaggacttgnttngataggtctactcgtaacaaaagtgattaaaaatgtggttcctgcagcttcatcggttcaagtcggggaaagcacttgtttccagacagttggttgaaatggctcccctaaaaatgaaggattactttgctgcgttcccgaactgggttggaatgtggaaaccgacccctttggttaaaatgaaagggggcgttttgttttccacctattggagggtttttcttttactttttccaaaaaggggggcaattttttgaaaattgggcattttggggtttcccccaagtggggccgaaaaccccccc

SEQ ID NO: 34706 - protein, 74 aa, Zea mays
  misc_feature: Ceres CLONE 1413405-F
MWFLQLHRFKSGKALVSRQLVEMAPLKMKDYFAAFPNWVGMWKPTPLVKMKGGVLFSTYWRVFLLLFPKRGAIF

SEQ ID NO: 34707 - DNA, 749 bp, Zea mays
  misc_feature: Ceres CLONE 1413406-F
  misc_feature: Encodes the peptide sequence at SEQ ID NO. 34708
aaagctggagctccccgcggtggcggccgctctatacactagtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggaggtcctggcagcggcgctgctgctgctggcggcggaggccgggacggcgtcggcggcggtgagctgcggcgaggcgacgtcgtcggaggcgccgtgcctcgagtacgcgatgggcagcgcggcgtcgccctccgcggcgtgctgcagcggggtgcgctcgctcaacagccgcgcgtctacggcggcggaccgacaggccacctgcaactgcctcaagagcatgacgggccggctcggcggcggcgtcagcatggccaacgccgccaacatccccggcaagtgcggggtctccgtcggcgtgtccatcagccccaccgtctactgcaccaagatcaactgatccatggaaccatagtgaaggtacctcgctcgttggatggcatcgtacgtggccatcacgagcatgcagacgtcgtcgtagcagacatgtactagctacgtgcgtgtcatgcatcacactggcacataatatagaagtagatcgtgcaccctctagtgatcgctcg

SEQ ID NO: 34708 - protein, 126 aa, Zea mays
  misc_feature: Ceres CLONE 1413406-F
  misc_feature (36)..(122): Pfam Name: Tryp_alpha_amyl Pfam Description: Protease inhibitor/seed storage/LTP family
MAARSSSQQLVAAEVLAAALLLLAAEAGTASAAVSCGEATSSEAPCLEYAMGSAASPSAACCSGVRSLNSRASTAADRQATCNCLKSMTGRLGGGVSMANAANIPGKCGVSVGVSISPTVYCTKIN

SEQ ID NO: 34709 - DNA, 793 bp, Zea mays
  misc_feature: Ceres CLONE 1413420-F
  misc_feature: Encodes the peptide sequence at SEQ ID NO. 34710
  misc_feature (33)..(33): n is a, c, t, g, unknown, or other
  misc_feature (220)..(220): n is a, c, t, g, unknown, or other
  misc_feature (226)..(226): n is a, c, t, g, unknown, or other
  misc_feature (237)..(237): n is a, c, t, g, unknown, or other
  misc_feature (238)..(238): n is a, c, t, g, unknown, or other
ggccgcggccctccacctcctcccacaacaaanggggggggggggcaaagtggggctcaccgcggtggggggcgctctatcctaatggagcccccggggtggaggaattctcacgagaccattacctagaacatcctaatcgaaaaagatgagtaacacccacagttgtccgatcaaagctagagtgtttacaatgtctaggacgatcaaagaacttcanaaaggncactcttctcnntacgaggttcttcctcgcgcccctctgcagctcgctactatgaggggaggagatgtacacgttcgtgaaggacccaacgctgccgcctatcgtgtcttattattactacatgatcatgggcgggggcacgtccgggtgtccgatgaccaccacgctggcggagaatttcctagagctgctggtggagcgcggagcctcgccctacgactaggagcgaatggcccaccagtgctgtgttgcggacactctgtcggacacctcgggaggatcgtccgtgcagagcttcgtgtatgaggacggatgtcatcaactctcgtccgcgcgtgctgcgatggggtagctgcatcaacgccgagcttctacacgcaggacttgcgactactacgggaagggcgtccgtcgggacctgaggtgccgcccatgcggcgtaacggaggagccggaacgacgtgcaggacgatccagtcctgacctgggggccccggtcatggccgagcctgccagggtgggtcctggctctaaggtacgggggttcgggctccgaaaaaaaagttt

SEQ ID NO: 34710 - protein, 52 aa, Zea mays
  misc_feature: Ceres CLONE 1413420-F
  misc_feature: SWISSPROT Homolog: EC 4.1.2.10 Mandelonitrile lyase
MYTFVKDPTLPPIVSYYYYMIMGGGTSGCPMTTTLAENFLELLVERGASPYD

SEQ ID NO: 34711 - DNA, 722 bp, Zea mays
  misc_feature: Ceres CLONE 1413422-F
  misc_feature: Encodes the peptide sequence at SEQ ID NO. 34712
  misc_feature (22)..(22): n is a, c, t, g, unknown, or other
  misc_feature (47)..(47): n is a, c, t, g, unknown, or other
  misc_feature (56)..(56): n is a, c, t, g, unknown, or other
  misc_feature (91)..(91): n is a, c, t, g, unknown, or other
  misc_feature (99)..(99): n is a, c, t, g, unknown, or other
  misc_feature (145)..(145): n is a, c, t, g, unknown, or other
  misc_feature (162)..(162): n is a, c, t, g, unknown, or other
  misc_feature (647)..(647): n is a, c, t, g, unknown, or other
tactgttgtagctctcttaggnggcggcccccccatttagcgtgggncctggggcngcccgaatcaccaccaccacccttgccgagaacancctaatcnaaaaaaattaacctgtcccatttgcaccgatccaccccccctcggnctcgggctccctccggncatggagggggtctactacgtcgtgttcgggggggtgggcggcgtcgtgggggggctcgagctcgggaagagggggaaggaccgggtcggcaccacctccggattcaactccttcaagaacaactacgtcctcgtctactccctcatgatgtccggggactggctggagggcccctacggctactacctctacagccagtatgggttcgacaagggggggagcgggcgcctcttcatcgccgggttcggatcctccatggtcttcggcaccatcgtcggctccctcgccgacaaacaggggcgcaagaggggctgcggcacctattggatcaggtacatcctcagctggatcaccaagcactcccccgagtacagggtcctcatgatcggccgcatcctcggggggatcggcacctcgctggtcttctccgccttcgaggcctgggtcggcgccgagcacaacaagagagggtttgacccccagnggctggccataacaatctctaaaggcatcttccttgggaacggcttaattggcattggatctgggctatttgccc

SEQ ID NO: 34712 - protein, 186 aa, Zea mays
  misc_feature: Ceres CLONE 1413422-F
  misc_feature (4)..(186): Pfam Name: DUF791 Pfam Description: Protein of unknown function (DUF791)
  misc_feature (162)..(162): Xaa is any aa, unknown, or other
MEGVYYVVFGGVGGVVGGLELGKRGKDRVGTTSGFNSFKNNYVLVYSLMMSGDWLEGPYGYYLYSQYGFDKGGSGRLFIAGFGSSMVFGTIVGSLADKQGRKRGCGTYWIRYILSWITKHSPEYRVLMIGRILGGIGTSLVFSAFEAWVGAEHNKRGFDPQXLAITISKGIFLGNGLIGIGSGLFA

SEQ ID NO: 34713 - DNA, 738 bp, Zea mays
  misc_feature: Ceres CLONE 1413430-F
  misc_feature (465)..(465): n is a, c, t, g, unknown, or other
  misc_feature (514)..(514): n is a, c, t, g, unknown, or other
caaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactnagatagtgtaaatagtagacttgttcgagtttagctgggctgggagaantagtctctggtccgtgttatatctgctagcaataatggctgcgatgaaacgagaagtattgggtgaatgtgaaaggaacataaatagtctcaagaaaagcgggagaaccccgctgcatatgctgctggcgtattcctgacctctgaatgcatcaccaactggcatgattctgctgttagggtcctcttgaaaaaacgaaaggaaaaatcggggcccttaaaaag

SEQ ID NO: 34714 - DNA, 688 bp, Zea mays
  misc_feature: Ceres CLONE 1413431-F
  misc_feature: Encodes the peptide sequence at SEQ ID NO. 34715
  misc_feature (466)..(466): n is a, c, t, g, unknown, or other
  misc_feature (513)..(513): n is a, c, t, g, unknown, or other
  misc_feature (557)..(557): n is a, c, t, g, unknown, or other
aaagctggagctccccgcggtggcggccgctctagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaaggatgaggcttgggagtataaacggcttgcggttcacgcagcttaaacttgtcatccttgcgttcttcatgttgtttgttctctggaaatgggagaagggctcgtcatactacgattccgaaatcctccagccagatccgttggttctgactcatccagctaactcgaagtttgtagaccagcatacatccccagaagaagactttccaagtgcagatcgatcacaccggtcagtaggtaaagtagaaaagccggntactagtgcgctgccaccattgtctacgataggctattctgttgatngtgcaaatgggaatgaagtgccacctcctgagaagaaagatgcnagtacaggaatgggaagtgggttctgacatcggagacactatactccgggttggtttggaagcatggctttcagaaaagtggcctgaaactaacccaggaaaagtttccgggatgaaaatttcaagggcgc

SEQ ID NO: 34715 - protein, 123 aa, Zea mays
  misc_feature: Ceres CLONE 1413431-F
  misc_feature (85)..(85): Xaa is any aa, unknown, or other
  misc_feature (101)..(101): Xaa is any aa, unknown, or other
MRLGSINGLRFTQLKLVILAFFMLFVLWKWEKGSSYYDSEILQPDPLVLTHPANSKFVDQHTSPEEDFPSADRSHRSVGKVEKPXTSALPPLSTIGYSVDXANGNEVPPPEKKDASTGMGSGF

SEQ ID NO: 34716 - DNA, 840 bp, Zea mays
  misc_feature: Ceres CLONE 1413432-R
attgggtaccgggccccccctcgaggtcgacggtatcgatattttttttttttttttttgaagcctgtattcagacacaaatacatagaaaacaaatgtacgtttcactcatgtcagtgctggtgcgaccatagagtgagctacagaccggtgtgcttgtgagcagtgagccaacaatgctgcatgcatgacggtacagtaactcatattcacaacccagctcaaactgtcatttatacacagcatcacaccccaacagaaattatgctatttgtacacggcaccttcagcagcatgcatgacggtaccagcttctgagctcagtttcataacaggtcgctggcagcctcatcacagttgggctaatatgataaccctgcccgctactcagctgtctcctcgagatggaacagcttcccccggacgactttccttggagggcaacggtcctcatcagacaacaccttcagcagtctttgttcaaatggcgtggtgtgccaactgaccctctgatcctctctgtatctggtcgttagtgtggggataccgttgccatcccatgccttgtgcaacctaggagtagggttactggtatccaagttgagatcaggtgcaaccatgaaagacaggcttctcagttagaaagctgcagtcttcatcatcttgattctcagcatctgcggaggaagatttcagccagcgggacaagctcagtgcagcgttcttttcatcccaagttggattttgacagggaatctttctactccctatgaagcaattaagatcaaggtgcagaatatgatgggaggttcagacagttcttgatttggacactggaac

SEQ ID NO: 34717 - DNA, 597 bp, Zea mays
  misc_feature: Ceres CLONE 1413434-F
  misc_feature: Translation starting site: 166
  misc_feature: SWISSPROT Homolog: EC 4.1.1.19 Arginine decarboxylase
  misc_feature (211)..(211): n is a, c, t, g, unknown, or other
  misc_feature (386)..(386): n is a, c, t, g, unknown, or other
  misc_feature (387)..(387): n is a, c, t, g, unknown, or other
  misc_feature (584)..(584): n is a, c, t, g, unknown, or other
  misc_feature (586)..(586): n is a, c, t, g, unknown, or other
agagctggagctccccgcggtggcggccgctctagaactagtggatcccccgggctgcaggaattcgcacgagaccattacctagaacatcctaatcgaaaaacagcactaaagtctattcatctctggctccccaaattcagctggagagcactttttcccatcatggataagaactacggtgaactctacaacatcctcggatggggtngaggagtacttcgcggtgaacacggaggggcacctcagcgtgaagcctttcggccgctggacggagcccgggcaggagatcgacgtgcactcggtcatcgtgggaagctctagcggacccaaccccaacgacaaggaccaggaaaatcttcaggttcccccagggaacccttttnnccttttcccccggagggggtttaaaaaaccggtttgagagcccccctaaaaagttttttaaaaacgggcccctgggggggacccccccccggggaaaacccccccccggaaaaaaaagggggggggccccccccccccgggggggggccaaaaaaaaaaaaaaaacacccctggtgaaaaaaaaaaaaaattttttnanccccccccccc

SEQ ID NO: 34718 - DNA, 734 bp, Zea mays
  misc_feature: Ceres CLONE 1413440-F
  misc_feature: Encodes the peptide sequence at SEQ ID NO. 34719
  misc_feature (1)..(1): n is a, c, t, g, unknown, or other
  misc_feature (2)..(2): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (30)..(30): n is a, c, t, g, unknown, or other
  misc_feature (31)..(31): n is a, c, t, g, unknown, or other
nnccccccccccnnnnnnnnnnnncccccnngccaccaacgaggggttggacagaactggagctccccgcggtggcggccgctctagaactagtggatcccccgggctgcaggaattcgcacgagaccattacctagaacatcctaaaaaaaaactctcgtctctatcgccgcatcgcttctctgccggagctccaacaacctcggctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtctgatgatttgctgaccagtgaagaggggtctatcaggatgaaggtcacgggtattatggaaaaagaaattgctcccattatgtcagcgtactgggaaaaggcagagtttccatttaatgccattcctaaacttgcaagccttggtggtggtggtggcacaataaagggttatgggggcccaggactttccattacagccagtgctgttactatgtcagaaattgcacggggagatgcaaggtggtccacatttatactgggggactcctctcttggcgatggggacaataggttctttgcggatcccagggtcagaagcagaagtacttgcca

SEQ ID NO: 34719 - protein, 159 aa, Zea mays
  misc_feature: Ceres CLONE 1413440-F
  misc_feature: SWISSPROT Homolog: EC 1.3.3.6 Acyl-CoA oxidase
MAGKRVTGRDGQDEGGAKVGLPAMDLSLAFPQATPASIFPPSASDYYQSDDLLTSEEGSIRMKVTGIMEKEIAPIMSAYWEKAEFPFNAIPKLASLGGGGGTIKGYGGPGLSITASAVTMSEIARGDARWSTFILGDSSLGDGDNRFFADPRVRSRSTC

SEQ ID NO: 34720 - DNA, 738 bp, Zea mays
  misc_feature: Ceres CLONE 1413448-F
  misc_feature: Encodes the peptide sequence at SEQ ID NO. 34721
  misc_feature (628)..(628): n is a, c, t, g, unknown, or other
cagagctggagctccccgcggtggcggccgctctagaactagtggatcccccgggctgcaggaattcgcacgagaccattacctagaacatcctaatcgaaaaaaccgcgccgctctctctctctctctcgcacgagccgcgccggcgccgccaccacgcgcgcgggagacagagaccacagccgcagccaccggcgggcggaataggaatggtggcgccggggggaggagcaggaggaggtccgtcgcggtggccggcggcggaggaggaaggatgcgtgcatattagtttccgatgaccccacctgatcatgtacctagctgaacaaatgggactggaactgatcttgtcaaagttgcatgatctcaaatgggaaaccccatcttgacactgtacggaagaaggtggtggagattagtggaagggatgaacaagaggttatggttgctgcttgcccctacagaatttgccctttgggggctcatattgatcatcagggtggagtagtcacagctatgaccataaattatggagtactccttggtttcgttccctctaatggttctgaggttttacttcattctggtcagtttggaggtgctataagattcagaagtgatgacttgncaaagcctattgataaacctgagacataaactggggaaagtatgcaaaggggctgttagtgcactgcagaatagtgatatgatctaaggaaggtatcataggatatattc

SEQ ID NO: 34721 - protein, 98 aa, Zea mays
  misc_feature: Ceres CLONE 1413448-F
  misc_feature (90)..(90): Xaa is any aa, unknown, or other
MISNGKPHLDTVRKKVVEISGRDEQEVMVAACPYRICPLGAHIDHQGGVVTAMTINYGVLLGFVPSNGSEVLLHSGQFGGAIRFRSDDLXKPIDKPET

SEQ ID NO: 34722 - DNA, 661 bp, Zea mays
  misc_feature: Ceres CLONE 1413454-F
  misc_feature: Encodes the peptide sequence at SEQ ID NO. 34723
  misc_feature (302)..(302): n is a, c, t, g, unknown, or other
  misc_feature (308)..(308): n is a, c, t, g, unknown, or other
  misc_feature (314)..(314): n is a, c, t, g, unknown, or other
  misc_feature (317)..(317): n is a, c, t, g, unknown, or other
  misc_feature (324)..(324): n is a, c, t, g, unknown, or other
  misc_feature (368)..(368): n is a, c, t, g, unknown, or other
  misc_feature (389)..(389): n is a, c, t, g, unknown, or other
  misc_feature (405)..(405): n is a, c, t, g, unknown, or other
  misc_feature (418)..(418): n is a, c, t, g, unknown, or other
  misc_feature (455)..(455): n is a, c, t, g, unknown, or other
aaaagctggagctccccgcggtggcggccgctctagaactagtggatcccccgggctgcaggaattcgcacgagaccattacctagaacatcctatcgaaaagttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacancctacnacgcantgntggtggnggccggcggcgcggggctcgggcggcgatcggcctctcgagcancgcttcacaccgcgtgcatcnacaagtcttcccacgngttcgacaccgtnggggttaggaagcataatgctgcccttgaaccatgantgaaatgactgtgagtgcatatgctgaccctggtaagggaacgattgcttggtgaccggattttattccgaaatttgcgaaaagggcccaaggttgtatagaagttggaaaaaattggcttccctttttccaaaatgtaaggggaaaaatattccacggggcctttggggggcgaaactttaatttttgaaaaggggccaaaccct

SEQ ID NO: 34723 - protein, 74 aa, Zea mays
  misc_feature: Ceres CLONE 1413454-F
  misc_feature (34)..(34): Xaa is any aa, unknown, or other
  misc_feature (36)..(36): Xaa is any aa, unknown, or other
  misc_feature (38)..(38): Xaa is any aa, unknown, or other
  misc_feature (39)..(39): Xaa is any aa, unknown, or other
  misc_feature (56)..(56): Xaa is any aa, unknown, or other
  misc_feature (63)..(63): Xaa is any aa, unknown, or other
  misc_feature (73)..(73): Xaa is any aa, unknown, or other
MWRSCVSRGLSRAKASASRLLSTASSSYTVVDHXLXRXXGGGRRRGARAAIGLSSXASHRVHXQVFPRVRHRXG

SEQ ID NO: 34724 - DNA, 759 bp, Zea mays
  misc_feature: Ceres CLONE 1413455-F
  misc_feature: Encodes the peptide sequence at SEQ ID NO. 34725
  misc_feature (759)..(759): n is a, c, t, g, unknown, or other
atagctggagctccccgcggtggcggccgctctagaactagtggatcccccgggctgcaggaattcgcacgagaccattacctagaacatcctaatcgaaaaaatccaacaagcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagccccttgaaatgaatgaaccatgcaggcgctgagcgagtctatacgtacgtcgtcaccggctgggcacgcatgcgaatgcgataagccgataaccatctcatatggacggaactatatattgtattccttttn

SEQ ID NO: 34725 - protein, 149 aa, Zea mays; identical to SEQ ID NO: 12336
  misc_feature: Ceres CLONE 1413455-F

SEQ ID NO: 34726 - DNA, 657 bp, Zea mays
  misc_feature: Ceres CLONE 1413456-F
  misc_feature: Encodes the peptide sequence at SEQ ID NO. 34727
  misc_feature (341)..(341): n is a, c, t, g, unknown, or other
  misc_feature (351)..(351): n is a, c, t, g, unknown, or other
  misc_feature (355)..(355): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccngggtggccgntggntggggaacttgtccaggtgatcctgcagcgacggcctttcatgacgtggggcgggaccctccgggagaagtacgggcccatcttccccatggggatggggcagccccccctcatgggggcccacccggggggagttcttccacgagggcctgggaaagacagggccccatgttccggaggccggcccaagaaaaacccccccccccctctctttaaggggggggaaaaggaaccctaatttcggggccctaaaggccccctggggggggggttttggcccgaaattttttggccggagagtg

SEQ ID NO: 34727 - protein, 120 aa, Zea mays
  misc_feature: Ceres CLONE 1413456-F
  misc_feature (41)..(41): Xaa is any aa, unknown, or other
  misc_feature (42)..(42): Xaa is any aa, unknown, or other
MDVNDVLLVVLAAALAAMWWRRCSKTGGVDGLPPGPPGWPXXGELVQVILQRRPFMTWGGTLREKYGPIFPMGMGQPPLMGAHPGGVLPRGPGKDRAPCSGGRPKKNPPPPLFKGGEKEP

SEQ ID NO: 34728 - DNA, 768 bp, Zea mays
  misc_feature: Ceres CLONE 1413466-F
  misc_feature (640)..(640): n is a, c, t, g, unknown, or other
aaagctggagctccccgcggtggcggccgctctataactagtggatcccccgggctgcaggaattcgcacgagaccattacctagaacatcctaatcgaaaacccgacatcctcgcttttgtttcccttcccccacccttcctcttcctccctatctatcaccactgctcgccggcgccgcctctgcaaaagggtcacttttgcctccggaacccagcggaatccgccgacggaccggaaacactcgctcgcccccctcaccccctgtctgcccggccgtcggagcgcgtcgtctccgggcgtgcaccagcatgccgtggaggcggagccgacatgatcaggagcaggaccacgacgaggcataatctgccgagaccgggacagcacgagtgggctgctccgctcgcgctggagccaaagctactgattgccttgtactgaccactccaaagaggcatctttgcgaggccatcacacgtgttcggtttgcacaaacaaaggtcagctcccttgcgatgcttgctgcaagatgcttgtgttcatacttgagaaaacaaaacggtgcatcatccttgctgacttggcccttcccgatctgaaaaagaaaacctgctgctggtctatgcatgcctgcccccgnataaaggggcgcccatccaagccaaacagatccttcggccgcaagaatttggcatccccctcttgaaaggacctccacgcccaaaaacgtgcgacctttaggaaggaacctgggcgctcattccccca

SEQ ID NO: 34729 - DNA, 664 bp, Zea mays
  misc_feature: Ceres CLONE 1413468-F
  misc_feature: Encodes the peptide sequence at SEQ ID NO. 34730
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaacaccggagggagaagaacaagtacggcttttcttctcttggcacggtcacggcgcggccgatcgaccgttcacctcgcccgacggcccaagcaggccatgtcttcgtctctgccctccccggagacgggaatccacgcgtcgccgccgttgggacttttgccggcgacggaaacccatcacaccaggtcatggggcaaaacaacctccacaagttgtactggttctaccaccaaacatgagcagagcttgcatggaaatgttaaggcgctgcaagtgcgggggggtgaatcctctcgtatggcttacagaagtccagcacttaaaaaccagtgcaatcttcctgatagttcttcctccactaatgtggataccacctttgatgataacgaacacgtgtcttccagtgttattgaagaacaagtggtaggactgttattagagcttggtgtgccagagacacttgacgatgttcaaccatttttattcaacctatttgctgatccagatatcattcgactccctaggctcttcaggtttcttcaaagaccactggccatacn

SEQ ID NO: 34730 - protein, 154 aa, Zea mays
  misc_feature: Ceres CLONE 1413468-F
  misc_feature: SWISSPROT Homolog: EC 4.99.1.1 Ferrochelatase
MSSSLPSPETGIHASPPLGLLPATETHHTRSWGKTTSTSCTGSTTKHEQSLHGNVKALQVRGGESSRMAYRSPALKNQCNLPDSSSSTNVDTTFDDNEHVSSSVIEEQVVGLLLELGVPETLDDVQPFLFNLFADPDIIRLPRLFRFLQRPLAI

SEQ ID NO: 34731 - DNA, 664 bp, Zea mays
  misc_feature: Ceres CLONE 1413470-F
  misc_feature: Encodes the peptide sequence at SEQ ID NO. 34732
  misc_feature (495)..(495): n is a, c, t, g, unknown, or other
  misc_feature (525)..(525): n is a, c, t, g, unknown, or other
agagctggagctccccgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggtcgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcggcgccggtgagttcaagcctgccttcccccggcggggcggcgggngaaggggcccaagggagaaaaaaagggggnaaagaaaaaaaaagccacagggggggggggaagcccccgggtggggaggggcaaaaaagagggggggccccccccccccgaaggggcaccaggtgggaaaacctgtggtgggaaaaaacccaacccctccccccccccc

SEQ ID NO: 34732 - protein, 165 aa, Zea mays
  misc_feature: Ceres CLONE 1413470-F
  misc_feature (110)..(110): Xaa is any aa, unknown, or other
  misc_feature (120)..(120): Xaa is any aa, unknown, or other
MAEETQPEAAAAAAPAAVEVVVTEAAPAEAEVPAAAEAEAEAKDEKKGDEAELTADDAGVGTGSFKEESNLVEDLPDPEKKALDEFKQLIAAALGAGEFKPAFPRRGGGXRGPREKKRGXRKKKPQGGGEAPGWGGAKKRGGPPPPKGHQVGKPVVGKNPTPPPP

SEQ ID NO: 34733 - DNA, 752 bp, Zea mays
  misc_feature: Ceres CLONE 1413471-F
  misc_feature: Encodes the peptide sequence at SEQ ID NO. 34734
aaagctggagctccccgcggtggcggccgctctagaactagtggatcccccgggctgcaggaattcgcacgagaccattacctagaacatcctaatcgaaaaccaatccgtgaaaagacgaacggggcgccggctcggacccggaggctgcagcgacaccggcatctgagaatctgcacgtcctggagcctccagcgactggtcccgccaccatctgcgcgcgcgcgcgagggaccggacgcggaacagaagcggcactgagatctgaacgactgcggcctggatgacgacgacgctggctaccggcgccgcgaaagcctcgacgactcggaggaggccgaggaggatcacgacaatgaccatcgacaaggtcaggccgatgacaacacagtgatgcatgcgtagtcaccacggaagcaaacgggtgtatgacacaggcaaaggccccgacgtcgccgacggcgaagccgacgactacgtagacaggcacaagtgtgatgacatgctcagtctgccgccccatgattctgaggtcctcattggtggcctgccacgcgacatcacggatgaggacctccgtgagctgtgctacacgatgagagacacatatgtagcgaggatgaccaaggatatggttgcataggacatgaaggtgctcatctatgatcacttcatggacaatgagactgctcatcgcgtcatctaggataggcgatactggaatgtcaagataccgacttgcggggctctct

SEQ ID NO: 34734 - protein, 81 aa, Zea mays
  misc_feature: Ceres CLONE 1413471-F
MRSHHGSKRVYDTGKGPDVADGEADDYVDRHKCDDMLSLPPHDSEVLIGGLPRDITDEDLRELCYTMRDTYVARMTKDMVA

SEQ ID NO: 34735 - DNA, 691 bp, Zea mays
  misc_feature: Ceres CLONE 1413472-F
  misc_feature: Encodes the peptide sequence at SEQ ID NO. 34736
aaagctggagctccccgcggtggcggccgctctagaactagtggatcccccgggctgcaggaattcgcacgagaccattacctagaacatcctaatcgaaaaagccagcaggacaccagtcatcttcttctcccccgcctcgtttccatcgccaccaccctcttctcctgcgggcctcccccgtcccactcccacccccctcgcctccgcctccactgcagctgccgccatgcagagcctcctcctgcccaccgctgccgtggccccggtggcgcctccgtgcggaaggcgaaatctcccgggacgcctctccgtccgcgcctccgagacggtggtagcggcaccgcggagcgagacggatcccaacaagagggtggtgatcacggggatgggtctggtctccgtttacgggaacgatgtatacgcttactacgaccgcctgctagtcggtgagagcggcatcgggcccatcgaccgcttcgacgcttctaagttccgcacacgctttgccggtcagatccggtgcttctcctccgagggatacatcgacggacagaacgaccgccgccttgatgattgcctccgatactgcatcctcagtgtgaagaaggctctcgaggtctccggtatcgcccacggctccaaggccatggaaaagattgacaagacccgcgccggtgtgcttgtgagc

SEQ ID NO: 34736 - protein, 154 aa, Zea mays
  misc_feature: Ceres CLONE 1413472-F
  misc_feature: SWISSPROT Homolog: EC 2.3.1.41 Beta-ketoacyl-acyl-carrier-protein synthase I
MQSLLLPTAAVAPVAPPCGRRNLPGRLSVRASETVVAAPRSETDPNKRVVITGMGLVSVYGNDVYAYYDRLLVGESGIGPIDRFDASKFRTRFAGQIRCFSSEGYIDGQNDRRLDDCLRYCILSVKKALEVSGIAHGSKAMEKIDKTRAGVLVS

SEQ ID NO: 34737 - DNA, 676 bp, Zea mays
  misc_feature: Ceres CLONE 1413473-F
  misc_feature: Encodes the peptide sequence at SEQ ID NO. 34738
aaagctggagctccccgcggtggcggccgctctataactagtggatcccccgggctgcaggaattcgcacgagaccattacctagaacatcctaatcgaaaaacaccggacgaagaagaacaagtagtgcttttcttctcttgtcacgttcacggggcggtcgatcgaccgatcacctcgcccgacggaccaagcaggccatgtcttcgtcggggccctccccggagacgggaatccacgcgtcgccgccgttggaccttttgccggcgacgggaacccatcacaccaggtcatggggcaaaacaacctccacaagttttactggttctaccaccaaacatgagcagagcttgcatggaaatgttaaacccctgcaagtggcggcgaatgaatcctctcgtttggcttacagaagtccagcacttaaaaaccagtggaatcttcctgatagttcttcctccactaatgtggataccacctttgatgataacgaacacgtgtcttccagtgttattgaagaacaagttggagtactgttattagaccttggtggtccagagacacttgacgatgctcaaccatttttattcaacctatttgctgatccagatatcattcgactacctaggctcttcaggattcttcatagaccactggccaaacttatttctacttg

SEQ ID NO: 34738 - protein, 158 aa, Zea mays
  misc_feature: Ceres CLONE 1413473-F
  misc_feature: SWISSPROT Homolog: EC 4.99.1.1 Ferrochelatase
MSSSGPSPETGIHASPPLDLLPATGTHHTRSWGKTTSTSFTGSTTKHEQSLHGNVKPLQVAANESSRLAYRSPALKNQWNLPDSSSSTNVDTTFDDNEHVSSSVIEEQVGVLLLDLGGPETLDDAQPFLFNLFADPDIIRLPRLFRILHRPLAKLIST

SEQ ID NO: 34739 - DNA, 764 bp, Zea mays
  misc_feature: Ceres CLONE 1413478-F
  misc_feature: Encodes the peptide sequence at SEQ ID NO. 34740
  misc_feature (1)..(1): n is a, c, t, g, unknown, or other
  misc_feature (17)..(17): n is a, c, t, g, unknown, or other
  misc_feature (23)..(23): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
ngggccccccccccccncccccnacccccccnncccanaaaatggggtccgggcaaggctggggctccccgcggtggcggccgctctagaactagtggatcccccgggctgcaggaattcgcacgagaccattacctagaacatcctaatcgaaaagattgatcttttttacatggtcaagttaagatgacattcatgattcatcagcgaattttcccaccgctcagcagttacctcgttcccgttctcctcctcgcatccctctcgtccgccgccgccgcctggctcgcgccgccgacagtttctcggcccagatcgagacacgcccgccgtcctacaccaggtgccgaggccttcgccgatcaaagagatcccagacagcagattcgtccgtgccctgctcctcgaaccatggggacctctgcccaggaatcgcctctctggaagcgtatcgacgatgccgagtactatctagtcagtggatcatttgaccagggggtgttgactgctttatccgccgccaatgaaaaacacatggcttctttggagagcgctagcaccaggatgagctcctggagaagcttgaaaccgctgggatggtgcttgtgccagccactaaaagaactcaggagggcctccggagatgttttgctcacgttaaagacggatgttttgggttcaggggcccttcagggggcttggttagaagtttttccctttacagggaacctacccattccaaaatgggaaaaaaagccgattct

SEQ ID NO: 34740 - protein, 117 aa, Zea mays
  misc_feature: Ceres CLONE 1413478-F
MGTSAQESPLWKRIDDAEYYLVSGSFDQGVLTALSAANEKHMASLESASTRMSSWRSLKPLGWCLCQPLKELRRASGDVLLTLKTDVLGSGALQGAWLEVFPFTGNLPIPKWEKKPI

SEQ ID NO: 34741 - DNA, 757 bp, Zea mays
  misc_feature: Ceres CLONE 1413484-F
  misc_feature: Encodes the peptide sequence at SEQ ID NO. 34742
  misc_feature (30)..(30): n is a, c, t, g, unknown, or other
taccttctgtgaggcttattaaccggcggncgctcttcacatagtggatcccccgggctgcaggtaatcacacgagaccattacctagaacatcctaatcgaaaattcctctctcctttgttcgcctacctatgtagcaatactgctgctcctcttacttgctcttcccgcggtagaaagcaaaaccgagaaccgtgcctccccctaccggctaccgctgttactcatggtcgcgcgcactgcctcctggcgccgccgcgaatgatccagacatgaatagggcgcacaccagcagctccaagctcatcaacgaaaagctcgtgaaacaccggatctccactgcgaagcactgcccccactgttttgagaaaatcaacagcaaaccggattgggtggagctgccggaaggcgtcaagctcgatccaactgaccaggagctgatccaccacctcgaggcgaaagcgaaagatgaatgctcgagatctcaccctctcatcgacgaggtcatacccacaatagatggggatgacgccatatgatacacccaccccgagaaacttccaggtggggacaagggattgagctaagcaagcactttcttccaccgggccggccaaaggccgtacacataccggtccccaggcaagaggaaggaacaataccgatcggagttgcgaaccttccacacagggcggagtacgaggtggggcacccaaaacccggtcaaagacgtctgaccgggtggatggtgtgaacg

SEQ ID NO: 34742 - protein, 88 aa, Zea mays
  misc_feature: Ceres CLONE 1413484-F
MNRAHTSSSKLINEKLVKHRISTAKHCPHCFEKINSKPDWVELPEGVKLDPTDQELIHHLEAKAKDECSRSHPLIDEVIPTIDGDDAI

SEQ ID NO: 34743 - DNA, 681 bp, Zea mays
  misc_feature: Ceres CLONE 1413485-F
  misc_feature: Encodes the peptide sequence at SEQ ID NO. 34744
  misc_feature (629)..(629): n is a, c, t, g, unknown, or other
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaaacacgctagtagaaatccctccaaacccaacgcctacaattacaaagatacaccgcctcccgcttccttctccgccatacctcgtgtccgacgagccctagggaacgcgagaccggccgtcggcgagagaaggactcgaatggagtgcgcaagggagttgcgggttcgctccacgtttacggcggcggccatggcgtccaagaagcaggtggggcctggaggcgcggttcccgctcaggaacagatgaacggcggcgatgccgccagactggtcaggaagccaatggatacatttccacagccagcggcggcaagaggccgtagggcacttgtcgacgttggcaatcttatgaatggccggccttctcttgtgaaccatcagaagcaagcggttgcggcagcggcaaccagtcataaaccactcaacgtcggcaacaagaagccacttgttcctcaggcagcagcaagaggcctgcgaccccttgccgacgttacgaatcttatgatcaaagaccgtgctgctcctgncaatcgtcagaagcctgtggatgctgtggttaacaggaaacggaaggcagan

SEQ ID NO: 34744 - protein, 146 aa, Zea mays
  misc_feature: Ceres CLONE 1413485-F
  misc_feature (130)..(130): Xaa is any aa, unknown, or other
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPXNRQKPVDAVVNRKRKA

SEQ ID NO: 34745 - DNA, 830 bp, Zea mays
  misc_feature: Ceres CLONE 1413490-F
  misc_feature: Encodes the peptide sequence at SEQ ID NO. 34746
  misc_feature (25)..(25): n is a, c, t, g, unknown, or other
  misc_feature (27)..(27): n is a, c, t, g, unknown, or other
  misc_feature (35)..(35): n is a, c, t, g, unknown, or other
  misc_feature (36)..(36): n is a, c, t, g, unknown, or other
  misc_feature (420)..(420): n is a, c, t, g, unknown, or other
  misc_feature (555)..(555): n is a, c, t, g, unknown, or other
  misc_feature (601)..(601): n is a, c, t, g, unknown, or other
  misc_feature (782)..(782): n is a, c, t, g, unknown, or other
ggggcccccccccccccccccaccnantggagggnntgggggggtcgtcaaggctggggctccccgcggtggcgggcgctctataactagtggatcccccgggctgcaggatttcgcacgagaccattacctagaacatcctaatcaaaagatttcgtaggaagtgctcgcaccatccctgcaaattacagctatggctcccaagatcctagtcgtccttgtgttcctcgccggggcctcagcggcggctctggccgccttcgatgtgatacagatgctggccgacaaggccaggaactccacggtgctgaaagctcctgccggaccaccacgtcgcgggcgaggggaatcggctccggtcggcgacttctgctggggcggccccgacacaattgccaagcctgcgggcgtccttgcccncctgataaggaggcgggccggggggtgtgagaagggcgggcgtgggggggcaccttcgagggccatgccggcccggacggagaagggaagagaaagagccggcaatgcaccccgggcggctgggctcctcccgtnggtgggacaagaaaaacctcggcgggccctgcgacctaccccccgncccccgcgcgagggggggaggacggaaccttcgggggggttcctcgggtgccctcaccggccgggggccaaaggctcaataaaaaggggccgacgcccaacaggccgggctccgtggcgcggggggtggtcatgcaaggagcacaaccccgagggaggccttatttttaaacagaaacagngtctacaactatacttgcgatgcggggtgtgttacgcgtcacgtatcg

SEQ ID NO: 34746 - protein, 212 aa, Zea mays
  misc_feature: Ceres CLONE 1413490-F
  misc_feature (76)..(76): Xaa is any aa, unknown, or other
  misc_feature (121)..(121): Xaa is any aa, unknown, or other
  misc_feature (197)..(197): Xaa is any aa, unknown, or other
MAPKILVVLVFLAGASAAALAAFDVIQMLADKARNSTVLKAPAGPPRRGRGESAPVGDFCWGGPDTIAKPAGVLAXLIRRRAGGCEKGGRGGAPSRAMPARTEKGRERAGNAPRAAGLLPXVGQEKPRRALRPTPRPPREGGRTEPSGGFLGCPHRPGAKGSIKRGRRPTGRAPWRGGWSCKEHNPEGGLIFKQKQXLQLYLRCGVCYASRI

SEQ ID NO: 34747 - DNA, 678 bp, Zea mays
  misc_feature: Ceres CLONE 1413495-F
  misc_feature: Encodes the peptide sequence at SEQ ID NO. 34748
aaagctggagctccccgcggtggcggccgctctagaactagtggatcccccgggctgcaggaattcgcacgagaccattacctagaacatcctaatcgaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggggggggggggctcttccgcgcgagcccgcgctacgggcgcttgcaagccacggcggcagttgaccctggaaatattccattggagaaagttcaagttaaaatcctcaggacatgttctgccatatgttgggcgttgcttgtttgggggctattctgtttgggtacccatcttggtggtggtcaatgggcggcctttgaatattctcggcgaagggatcttgggaattgctgaaaaaatggtgtctttggaggggggggggggggttagcacatcccttggggtgggtggaaacactaagg

SEQ ID NO: 34748 - protein, 136 aa, Zea mays
  misc_feature: Ceres CLONE 1413495-F
MMRCAATGGGCVASWSGDWRLPAVNPCSVRMPTGNDGWCAGLRSRAADLAGLEMANLRGGGGGLFRASPRYGRLQATAAVDPGNIPLEKVQVKILRTCSAICWALLVWGLFCLGTHLGGGQWAAFEYSRRRDLGNC

SEQ ID NO: 34749 - DNA, 800 bp, Zea mays
  misc_feature: Ceres CLONE 1413496-F
  misc_feature (1)..(1): n is a, c, t, g, unknown, or other
  misc_feature (2)..(2): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
nnccccccccccccccccncccccccnntgggtanntgggggcctgcccaaaactggtgctccccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcggggggttccaccacatagcttcgtcgttttgaatttgatgtactaatggagtctaaggggggcaagaagtctagcagtagtccgttccatgatgtatgaagctcccccttgtctacagcattgaggacgttcgacctgccggaggcgccaaaaacttccagtctgctgcttactcccacggggaaaagaagccatccctgaaatcccctttttggttccctccgtctagaaggtttagggatttcctttttctggaccctgtcgattcttaaccaatccccccctgggccttggtggctttcctggacaacccgaccaaggttccccaagttcttggctccactggcaatccctccccttccttccaatcttccagcggttgggggttcccgacctccaccccggccaccaagggggctggtcttttttccgggcgcggtgggttgttcccccccggggccctccaacctaacccggggattttggggggtcct

SEQ ID NO: 34750 - DNA, 657 bp, Zea mays
  misc_feature: Ceres CLONE 1413498-F
  misc_feature: Encodes the peptide sequence at SEQ ID NO. 34751
  misc_feature (317)..(317): n is a, c, t, g, unknown, or other
  misc_feature (342)..(342): n is a, c, t, g, unknown, or other
  misc_feature (343)..(343): n is a, c, t, g, unknown, or other
  misc_feature (657)..(657): n is a, c, t, g, unknown, or other
agagctggagctccccgcggtggcggccgctctagaactagtggatcccccgggctgcaggaattcgcacgagaccattacctagaacatcctaatcgaaaactccttgctctgccgagaagccggcgatgaggggccgcaagaggcagcaggtgagcgccagctcggccgccgcgctggtgaaggggagggagagcaccaaacagaaggagaaagaagctaggaaggagaaggaggcgagggaagccggcagggagccggcggcgaaggagaggctgatgaggcgcaaggccgggaaggagacgggtggagaggtnaaggagccggcgaaggaggtgaggnnagagggcaagcaaaacgacacgcaggagaaggcgaagggcaacgtctgcccgcagttcttcaaggtcttcttccccgagcagtccacggagcgtctgagaatcccaaccatgttcaaccagcacctcaaggagcagcagccaaccggagcagtttccctgagaggccccagcggcaacagatgggaggcagcgctcgcttcccaatccgagtcggaggccgcgtggggcttcaacaggggtgaaaggattttgcaccggaccctcccctcggttaggccacttctggtcttcacgggcgacgggcccccccgtn

SEQ ID NO: 34751 - protein, 176 aa, Zea mays
  misc_feature: Ceres CLONE 1413498-F
  misc_feature (72)..(72): Xaa is any aa, unknown, or other
MRGRKRQQVSASSAAALVKGRESTKQKEKEARKEKEAREAGREPAAKERLMRRKAGKETGGEVKEPAKEVRXEGKQNDTQEKAKGNVCPQFFKVFFPEQSTERLRIPTMFNQHLKEQQPTGAVSLRGPSGNRWEAALASQSESEAAWGFNRGERILHRTLPSVRPLLVFTGDGPPR

SEQ ID NO: 34752 - DNA, 684 bp, Zea mays
  misc_feature: Ceres CLONE 1413500-F
  misc_feature: Encodes the peptide sequence at SEQ ID NO. 34753
  misc_feature (396)..(396): n is a, c, t, g, unknown, or other
  misc_feature (564)..(564): n is a, c, t, g, unknown, or other
aaagctggagctccccgcggtggcggccgctctagaactagtggatcccccgggctgcaggaattcgcacgagaccattacctagaacatcctaatcgaaaaatcgattcattcaactgaacagcaagcgcacctaccctacccgccgccgccgaaggcgaaggcctagctcccggtccggcgcgatggctgccgcggcccgccgcggcccgccgcggccccggggcgctcctcctcgtggcgctcctcctgctggcgctggtcgtctccgggcactgcctggacgcgcaccaccgcgggctgaagcgccgccggcggaagcacgagattcactctccgatcaagacggtggtggtcgtggtgatggagaaccgcagcttcgaccacatcctcggntggctccgccacacccgccccgacatcgacggcctcacgggccgcgagtccaaccgcctcaacgcctccgacccctcctccccggatatcttcgtcacggacgagggcggctacgtcgactccgaccccggccacggtttcgaggacatcggggagcagatcttcggntcccgcgacacctccggggtgccgccgcccatgtccggcttcgccccagaacgcgcgcggcatggggcctcggcatgccgcagaacgtcatgagggggttccaggcccgacgccctcccg

SEQ ID NO: 34753 - protein, 97 aa, Zea mays
  misc_feature: Ceres CLONE 1413500-F
MENRSFDHILGWLRHTRPDIDGLTGRESNRLNASDPSSPDIFVTDEGGYVDSDPGHGFEDIGEQIFGSRDTSGVPPPMSGFAPERARHGASACRRTS

SEQ ID NO: 34754 - DNA, 638 bp, Zea mays
  misc_feature: Ceres CLONE 1413503-R
ccgggccccccctcgaggtcgacggtatcgataagcttttttttttttttttttaatctccaaccccaatctatctattaagctaagttcacgtcccatacataatacggaaataatcctctggctttcttgccccctgcactaattcataacgcgacacttcctgacttccattatcactaattcataacagaaaacgggttccaaatctaataatgcactcagcactgaatgcgatacagcaggaaaggaaaaactccggtggaggtaacaatatactgtaaatacacaaggcaagagcaacgaagtcgcagcactaacttctggggatgaactgtgagcctatgatgccctgccagagaactgtcatcatagatgttagaagacggcacatgcagatgctagaagtaatttcactccaagctgtccaaccccacccctagaaacgcaagggcgtacgcgtgcaactcactcgggaaacaacgtgagacctccactcgactctgcttccctcagaaaacccgaactgtgcttgccctcccatgggttactggaatatatgccccaagaccccccgcaccaaaagccacttcccctttccgaatttgggggctagtgggcccttgccccccgtttgt

SEQ ID NO: 34755 - DNA, 752 bp, Zea mays
  misc_feature: Ceres CLONE 1413504-F
  misc_feature: Encodes the peptide sequence at SEQ ID NO. 34756
  misc_feature (1)..(1): n is a, c, t, g, unknown, or other
  misc_feature (2)..(2): n is a, c, t, g, unknown, or other
  misc_feature (31)..(31): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (752)..(752): n is a, c, t, g, unknown, or other
nnccccccccccccccccccccccccccccncctggggggggggnnngggcagagctggagctccccgcggtggcggccgctctagaactagtggatcccccgggctgcaggaattcgcacgagaccattacctagaacatcctaatcgaaaaaaacgcaagaaacacgaaagcaagaaccggaaggaacagccacgccaatatacagagcgagccagcacacagtttttttcataaggctggtctgcaattaggtgcctcgactgcttgctagccgccggattaatctttccctaccctaaggctcaggttttagtgggatatgatgaagctaaaaagtggacgacgaccgttctataaggatgttaagcctgtagactgccgttcaggctcaaggtcttccacatttggctgctcaagcaaaggtgtgcggggcgtgaacatgcagaatgaagatgtcaagcctcgtcgaccagttcaagtcagacgaaggagatgggttcttggtgatgtaaccgaggtgttggatcataattcgtggaggcttgggaagattacagaagttctgaagaatgactattttgtcatcagggctagtggggttggatccaaccaagagaattccacatatctggggttgaggattccacatgaatggaaggcaggttgactgtttggagggaagggaccatccaaggctaacgaaagagggggggatcccctatgcgtaaagaggaaaagcaggcccaatn

SEQ ID NO: 34756 - protein, 115 aa, Zea mays
  misc_feature: Ceres CLONE 1413504-F
MMKLKSGRRPFYKDVKPVDCRSGSRSSTFGCSSKGVRGVNMQNEDVKPRRPVQVRRRRWVLGDVTEVLDHNSWRLGKITEVLKNDYFVIRASGVGSNQENSTYLGLRIPHEWKAG

SEQ ID NO: 34757 - DNA, 682 bp, Zea mays
  misc_feature: Ceres CLONE 1413513-F
  misc_feature: Translation starting site: 160
  misc_feature (498)..(498): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
gctctagaactagtggatcccccgggctgcaggaattcgcacgagaccattacctagaacatcctaatcgaaaaagatccattgttcacgacctcaccctattcagatcccaagcggccacgcccaagcccaaaccctacccacccatctcaaccagcgatgatggcagcggagccctcgccgtcggttccctccaccgccgctgaagacatggaaaccctcgccctcgactcatcctcttcgtccgccgccgctacggcctccgcctccgaccccctccttcggccacctacctccccgaccgccgccgcgagcgacgaccccttcgtcatcgacgacttcctcgacgaggacgacttcaccgccccggcgcccagcgtcgccggcccgccgcccgccgggcttggcgatgcggcgtccccagtgttccccaagatcaccgtatccgatcccaagaagcacgccgagcctagcgggcgggggtgcttgccggtgtgnatccccgggatccggcagctacttttcttacctcatcaccacccgttttgcgggcgggnnnngggggaaagtcagcgttgcggcggcgcttccccggggaggtggggggccccctcgcgggacgggccttgccgcaagctcaccgcgggggtttatttggtcccggggccggccccgacaaagg

SEQ ID NO: 34758 - DNA, 690 bp, Zea mays
  misc_feature: Ceres CLONE 1413516-F
  misc_feature: Encodes the peptide sequence at SEQ ID NO. 34759
  misc_feature (463)..(463): n is a, c, t, g, unknown, or other
  misc_feature (464)..(464): n is a, c, t, g, unknown, or other
  misc_feature (615)..(615): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcaaaaaactctcgctttcttctgtctcgcctcgccctcgcctttgttgatcttttcctttctcgcgttcccctcgccttcctcttcctcccccacacccaccggtcgccgcccccgtcgccccggcctcctcggtccagagacgagggggtccgcgccgttccgacgccacaccgcaaccgcatcacatcaccgcctgctcccaccgtccatccgccctccctcgatcgcgctccccggatcgctggtacctccgcgcgcggctccgacctcatcttcctccatcgactggcatcggcagcggcggcgtgttcccggccaaccttcgaaagggtaatcaatcgccagacttttgggagctgtgttgnngggggaccggggggaagagccaagttactgcagaggctaacatttcggttgtcgagtgatggcgcaaggcatcaacttccctgacttcatcggcgccgtgggtggccatggatggtggcgtggactttggtggggacttctgtgacatggncttctaccagaggctaggggaggcacccancatgtcggtcgacagcctcaacagcatgcagacagaatgggcatg

SEQ ID NO: 34759 - protein, 39 aa, Zea mays
  misc_feature: Ceres CLONE 1413516-F
  misc_feature (15)..(15): Xaa is any aa, unknown, or other
  misc_feature (25)..(25): Xaa is any aa, unknown, or other
MDGGVDFGGDFCDMXFYQRLGEAPXMSVDSLNSMQTEWA

SEQ ID NO: 34760 - DNA, 618 bp, Zea mays
  misc_feature: Ceres CLONE 1413519-R
ccgggccccccctcgaggtcgacggtatcgataagcttttttttttttttttttattttttctcgtcaaagaaactggatgatttttttagactgttatcacagtaaataggaaatgtagttgtgttgtattttgtgtccaggtgtttactattgaaattccaagcagctgatgagttcttgtccaaaacttgctgcatacatgcagtgtgaaactgaggcaactcctccaagcagtgtcttctcatcaatcattctgccaattcagagagtgggaagcagcatatacagcagtacaactcatggtactcagtactgataaaatttgttgtacaagccaagcgggggaaattagccaaattaacgctgaaaacatactggaagaccaatactccgtacccattacgcgttctgatgggctagacaacccaccagacccgaagccccaaactaccacaatatcaagacgcaaaaactagagaaataaacaagctagatcaaaaggtcctcaagttcttcaccaatgcagattcgactgcccatgtgcctatgtacaaatggttggtacgctgtgcatgacccgctcaacctgtatggtctccccctgttgaatcggaga

SEQ ID NO: 34761 - DNA, 655 bp, Zea mays
  misc_feature: Ceres CLONE 1413521-F
ctagaactagtggatcccccgggctgcaggaattcgcacgagaccattacctagaacatcctaatcaaaaaacacgcgcgcacgtaaaaacgaaaaaaggtccccggccgagaccgagagccgcggtccagagcggggggcggccggcaaggacgaaacggcccaacgccaccacctccaccacctcgtcctcgatcgacacctcccccgtcgccgtcccgtgactccccgtccagccgtccaggcccagctgcccccgcgacccagacgaccacgtccgcctcggcctgcgcctccccgctacaagagtccgtccgcccgccagcgctgcggtgccagggagggggtggctcctccactctctgcggcgcggagatcccgtcctttctctgtgcccccggtaccgcgaggagccactgccaggcgccggcgtttttggaactgggcatggaggcggcggcggcggcttcggcggcggtcgggggttcgggcgctggactgaccaggtggcagcggcgggtttttgcggggtgggccggctggggtgtggggcggcctccttctacgacctcacgggccgggggggcgcgctcggtccaggccgggggtcacgggccgggtgcacgcccgagacgccggccatcctcagggttcc

SEQ ID NO: 34762 - DNA, 711 bp, Zea mays
  misc_feature: Ceres CLONE 1413522-F
  misc_feature: Encodes the peptide sequence at SEQ ID NO. 34763
  misc_feature (523)..(523): n is a, c, t, g, unknown, or other
aaagctggagctccccgcggtggcggccgctccatgaaccagtgcgagctgcggatctcggaggattctgacgatatcctcacctatatacttccctcttcgacaaccccatccgtggtgctcccggtgcgccaggctaccagagtctgactcagacgtagctcccggccacagcagagcccacgccttgagcccttgacgcgctccgtgtgagcgcagcgtacgggcgccggccggcggccagagaggaaacggatctaggaggctcagctgagtcgagcatatgcaccgcagagatgtcgaggatcctcgccatggagatctactgtcccgccctccggggtgcagcaggaggcacttgaggtccatgatgagtcgagcagagggaagtacaccattgacttggggcaaaagtgcatgcccgtctggagcgagggggcggatgctatctatatgagggtgacggtggacaattctctgctgaaacaatacgagagcgatctcaaggtagtcggtcgctttnatctctggaagggaggcacgctatagacgaataggaaaccccatcaagacttggctcgatgcggatgtttgggggaagggggccatccagtgcactttcgaagggtggggggctccctggaaaggtatgtggatgggcggcgggcggcaaggccccacctgaattgggggtgaattgggggtaccaaa

SEQ ID NO: 34763 - protein, 43 aa, Zea mays
  misc_feature: Ceres CLONE 1413522-F
  misc_feature (36)..(36): Xaa is any aa, unknown, or other
MPVWSEGADAIYMRVTVDNSLLKQYESDLKVVGRFXLWKGGTL

SEQ ID NO: 34764 - DNA, 811 bp, Zea mays
  misc_feature: Ceres CLONE 1413526-F
  misc_feature (1)..(1): n is a, c, t, g, unknown, or other
  misc_feature (2)..(2): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
nnccccaaaattttnnnttcactgtacggcgagagggccggttaaaaaaagtggggctccccgcggtgggggccgctctagaactagtggatcccccgggctgcaggaattcgcacgagaccattacctagaagatcttaatcgaaaaaaaactagacgagaagagagagagagggagagaggggaaagttgattctctctctgagccgcccactccctccttcgctggtccggtcgcactccgtcgttcctccgcgcacgtacgtacagcagccagacaccgagatcgagtggtacagggcccgccagaaacctcacgagctagctggttcctgatcggcggcctgtgccgcgcgacgatccacgcatggcgccgccgctcctgcccgcgcgcttccgtcgccgacctccgtcgcggtgatcgccggtcaccttctcctcctctctaacggcgtccggccaggtggaaaacgatccggtccgatccgaagggggaacataaaccaactcaggggggaccggggataaccgcggaactgggggatgggttatggtgggcccgtccggtttccgctataccagctagccggggagtaaccggcaacaatccatggtgcccgggggcggggagggttaagggcttgggcggtggggcggaagagaaaggacgggggattctggcggcgaaaggaaccggcgcggcccaggcgcaccactagtaacggcgggacggggacgccggggtacacagggcgcagtgtgttattccagccttgtgcgtgtctgtgggtcccacctcgggaaagattag

SEQ ID NO: 34765 - DNA, 665 bp, Zea mays
  misc_feature: Ceres CLONE 1413530-F
  misc_feature: Translation starting site: 208
  misc_feature: SWISSPROT Homolog: EC 2.3.1.119 Icosanoyl-CoA synthase
  misc_feature (468)..(468): n is a, c, t, g, unknown, or other
  misc_feature (503)..(503): n is a, c, t, g, unknown, or other
  misc_feature (512)..(512): n is a, c, t, g, unknown, or other
  misc_feature (524)..(524): n is a, c, t, g, unknown, or other
  misc_feature (526)..(526): n is a, c, t, g, unknown, or other
  misc_feature (527)..(527): n is a, c, t, g, unknown, or other
  misc_feature (636)..(636): n is a, c, t, g, unknown, or other
agagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtgncgcaagggtgtgggggaggccacctacgacctcgncagcgtggntcgcttcctcgncnngtctcgcttcaccatctccgtctacatcatgtccaggccccaggcccgtgtacctcatcgacttcgcatgctacaaagccgccgacgagctcaaggtgtccaagggcgnagtcatcgacctggcgcgcaagtccggca

SEQ ID NO: 34766 - DNA, 689 bp, Zea mays
  misc_feature: Ceres CLONE 1413531-F
  misc_feature: Encodes the peptide sequence at SEQ ID NO. 34767
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaactctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgcgccgggaaggtgcgcgggaacgatttccagtctaaagagctccccaacacccgcatcgagcccgaccgccggtggttcggcaatactcgcgttgtgggccagccacagcttgaaatgttccgggaggaactccagagtcggctttccgacaacttcagtgtcatcctgaaagaacggaagctgccactatcgctcctgcaagatcatcanaagcaagcgaagggacatctggcttgaagttgaacctttttgagcatggttttggagccaagggcaaagaggaaacgtcccgaaactaactgctcttgactacggatcttt

SEQ ID NO: 34767 - protein, 136 aa, Zea mays
  misc_feature: Ceres CLONE 1413531-F
  misc_feature (49)..(136): Pfam Name: NGP1NT Pfam Description: NGP1NT (NUC091) domain
  misc_feature (128)..(128): Xaa is any aa, unknown, or other
MAKKKEKAVNVSGKPRHSNDVNRPNDKKGAGGGAGGGSRSAATVRRLKMYKTRPKRDRAGKVRGNDFQSKELPNTRIEPDRRWFGNTRVVGQPQLEMFREELQSRLSDNFSVILKERKLPLSLLQDHXKQAKGHLA

SEQ ID NO: 34768 - DNA, 744 bp, Zea mays
  misc_feature: Ceres CLONE 1413535-F
  misc_feature: Encodes the peptide sequence at SEQ ID NO. 34769
  misc_feature (19)..(19): n is a, c, t, g, unknown, or other
  misc_feature (21)..(21): n is a, c, t, g, unknown, or other
  misc_feature (26)..(26): n is a, c, t, g, unknown, or other
  misc_feature (27)..(27): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (60)..(60): n is a, c, t, g, unknown, or other
gtgcccccccccccccccngntaaannaaagggaatnntccccnnnnnnccaaagctggngctccccgcggtggcggccgctctagaactagtggatcccccgggctgcaggaattcgcacgagaccattacctagaacatcctaatcaaaaaatcgcccagacatcctcaggcagcttcgagttccacgacgagagcaccggcggccgcagacgagtttggctcctcgacggaccttcccggcaccgccgccggatctccctcaggggccactacactccacagcaccgccgtcgcacaacgacatggactcctccgctacctatctcatgttcgccagcgcccacgctcccctcgctcctctcataaggccaccgacgatgggccttgtcgggagaaccgccgcaagctccatcactaggcgcgaaagagccagtggccctctgttagtcaaccccgctgcgtgccggccgggactgcggcgccgtggctgggcacatatttgaagagactcgtccctgcagtgcccttcgggtgccgattctcctgctcaggagcaagaggatctgaagaagagggaggtggtggcagaggctgcggctcgaattgccggaggaagtggtgggacgttaagggactgggacacgtcgggtgctcatcttcgggaatctgggggggggacctcatggacgtacgctttcccggctccccggctaaaccagacaagcatatccgcagacgccg

SEQ ID NO: 34769 - protein, 66 aa, Zea mays
  misc_feature: Ceres CLONE 1413535-F
MDSSATYLMFASAHAPLAPLIRPPTMGLVGRTAASSITRRERASGPLLVNPAACRPGLRRRGWAHI

SEQ ID NO: 34770 - DNA, 838 bp, Zea mays
  misc_feature: Ceres CLONE 1413541-F
  misc_feature: Encodes the peptide sequence at SEQ ID NO. 34771
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (19)..(19): n is a, c, t, g, unknown, or other
  misc_feature (49)..(49): n is a, c, t, g, unknown, or other
nggggggnnaanntttctntggctatactggatggggggggggcgcccngcccaaactgggactccccgcggtggcggccgctctagaactagtggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttaattgctgccgttgttgttgaaaacggggagctcggagggctccgtgatttccccgccgatcgggttcggggaaacgtggaaagcctatgggaatctcctccgcgggcccgcaattcgtcagaacctctcccctcgaggctgcacttcctcgttgggcccacggccccacgcgtcggggggggaatggcgggcagccccgcggcccgctggccgcctggttccaaccgaaccgcgaaagctcggggagcgccccccgggggcccgcgggagacgcccgaacccccgcacaacggaaacgaacctgcggaaccggggggggggacacagacacctttcctccctctccctccggggaacattccccctctggggagaacagggcgcgcccgccgcgccggctgccccgaagaaaaccgggtgggaggaggtgcaggggg

SEQ ID NO: 34771 - protein, 37 aa, Zea mays
  misc_feature: Ceres CLONE 1413541-F
MVFSDAASPLVATAADSASSCVAHLPCCCRVNCCRCC

SEQ ID NO: 34772 - DNA, 674 bp, Zea mays
  misc_feature: Ceres CLONE 1413562-F
  misc_feature: Encodes the peptide sequence at SEQ ID NO. 34773
aaagctggagctccccgcggtggcggccgctctagaactagtggatcccccgggctgcaggaattcgcacgagaccattacctagaacatcctaatcgaaaaattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcgggggcgatcctgatgcggggcgcgggcggtgaatggcagcgccatccggcggtgggggcggcggtgcgggggagggctcctcctcggccgccgcaactgcaacaatgggggccacgggttgaaccagttggcaaaggcaatgtggcataatgaatttggaaaaacccctggaaactggggccaaaccccaaaggggggtgggggaccccaactgggacttattaacttgagggaatggcatgggcccgggttgtggaaaaccccgagaaaattaaaccccccccccaaaaaaaaaacacttcctcttttcccctccccctcaaattacagggggcaaaactcccccccaaaaaaatcggggacccccctgaaaggccccaaaacaatttttaaaaaacatggcggcgcccgccaaaattttgc

SEQ ID NO: 34773 - protein, 45 aa, Zea mays
  misc_feature: Ceres CLONE 1413562-F
MRGAGGEWQRHPAVGAAVRGRAPPRPPQLQQWGPRVEPVGKGNVA

SEQ ID NO: 34774 - DNA, 739 bp, Zea mays
  misc_feature: Ceres CLONE 1413565-F
catagctggagctccccgcggtggcggccgctctagaactagtggatcccccgggctgcaggaattcgcacgagaccattacctagaacatcctaatcaaaaaggaaaaggggacaaaccaccaacaacaaccagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccccgggaaggacgagtgaataatcatgaactcgatctgccctttcgcgggagccaccactggtggtggtgtattgccctgtgaaatctgataaaaaaaacactggggtgtgccctgcaaaatctgacaagagcatcagtggggtatgccctgtcactgggaaggaacatggtaacaagctccaagaaaggggtggtcctgggggaaaaaaagggacccgatcctcggggtgtaaccacaaaaaggccatttcgggtatgacttccaaaaattttcaagctggggcccgcttagctggaattgcccggc

SEQ ID NO: 34775 - DNA, 735 bp, Zea mays
  misc_feature: Ceres CLONE 1413568-F
  misc_feature: Encodes the peptide sequence at SEQ ID NO. 34776
  misc_feature (735)..(735): n is a, c, t, g, unknown, or other
agagctggagctccccgcggtggcggccgctctagatcacgtggatcccccgggctgcaggaattctcacgagaccattacctagaacatcctaatcgaaaagacgagaaaaccccacagcctgcacctcggggacgccggcgcggagggatggagtgccacgccctacagtgatttctcccccgctccgatccccggtgcatgaccgggtcggctggtctatgcatcgcaggaggagttgtcgtcgattgcccctgcctgccccagttaatcccgcccgggcgcaatccagtattagaggcgccgatctcctgccccgtcctgccctggggattatcgacagcggcgccggataccacggaagagaacgaacacaaggaagggggggaaactaacttgcttgtgccgggacaaggacaacatcgagggcagccgagtcgctacccgaaactctaggcgagattggcagagcaggttcccacaatagaagtatacccaatggatcgagaaggttctcaaaagaaaagacataattctgctacaaatgttgacatcatcactaatctacctgatgttattaaagacaaaattctctgctggtgtgcaataaaagaaactggaccaccatgtctcctcggcaggcaatggaagtacccttgggcttcaatgactggatgggggtccaaaaaaaaggattttgctttagccaaggggaatgaaaacggggacgcgacn

SEQ ID NO: 34776 - protein, 79 aa, Zea mays
  misc_feature: Ceres CLONE 1413568-F
MDREGSQKKRHNSATNVDIITNLPDVIKDKILCWCAIKETGPPCLLGRQWKYPWASMTGWGSKKKDFALAKGNENGDAT

SEQ ID NO: 34777 - DNA, 727 bp, Zea mays
  misc_feature: Ceres CLONE 1413574-F
  misc_feature: Encodes the peptide sequence at SEQ ID NO. 34778
aaagctggagctccccgcggtggcggccgctctagaactagtggatcccccgggctgcaggaattcgcacgagaccattacctagaacatcctaatcgaaaaacatgttacagcgactcggcctgccgcgatttttataatgcgccgcggtggccgtcgctagtggtacatatcagcaccgcccctgcctcgaggttgcgtgttttgttctctgtgagcgccgtgggtgttgatggcgtcaacggcgtactcgcggccatccaagccgccagggccggcggccggagacaggagcggaccgcggctggccaaggagctcggcaggatcgagcccaagaagctgggcatcgggctggttgccggctgctgcttcgcgctgctcacctacctctcctttgcccggctgtttgccatctactcgccggttttcgacagctcgtcgtccatggtgttgaagaacatgccgccagcaacgacgacggtgccgggtacagctacaggggcgctgccggtggagcaaaaggcccaagtggaggagcagaaagaggttcgtgaccctgaggcggacccgcacatgccaaacttaccggaggtcacagaaaaggatcagcaggaggaggccacggcgacgaagccagccggtggtgccattattacagaggccaagatcacctgcgacgagaacggcgtcgacgagggcttcccgtacgcacgggccgccggtttg

SEQ ID NO: 34778 - protein, 165 aa, Zea mays
  misc_feature: Ceres CLONE 1413574-F
MASTAYSRPSKPPGPAAGDRSGPRLAKELGRIEPKKLGIGLVAGCCFALLTYLSFARLFAIYSPVFDSSSSMVLKNMPPATTTVPGTATGALPVEQKAQVEEQKEVRDPEADPHMPNLPEVTEKDQQEEATATKPAGGAIITEAKITCDENGVDEGFPYARAAGL

SEQ ID NO: 34779 - DNA, 790 bp, Zea mays
  misc_feature: Ceres CLONE 1413575-F
  misc_feature: Encodes the peptide sequence at SEQ ID NO. 34780
  misc_feature (139)..(139): n is a, c, t, g, unknown, or other
  misc_feature (311)..(311): n is a, c, t, g, unknown, or other
  misc_feature (326)..(326): n is a, c, t, g, unknown, or other
  misc_feature (355)..(355): n is a, c, t, g, unknown, or other
aaagctggagctccccgcggtggcggccgctctagaactagtggatcccccgggctgcaggaattcgcacgagaccattacctagaacatcctaatcgaaaactctcgagcctgacccttacgccttcgctcgcgccgnccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgangtctgtgggaagttngctgtgaaagagaaagcagttggaatttnggggtgcaaggactgtgggaaggtgaaggctggtggtgcttacaccatgaacactgctagggcggcaccgtcaggagcacgatccgccgcctgagggagcaaactggaccatgaaataacctccttaaatattggggtttcccgggaattgcccttggcaaggatggttggggggcgctttaccaaggggaaggggggaaccaccggacctgtttggttttcccaaaaaaagggcccctaaattggggtttagcccccagggcctccaaaaaaaaaaaaaaaaacttttttttcccccccccccccccaggggggggggcgcggaaccaaattcccccataaagagggggataataccccgcgccccccgggggcccgtttttaaaaaggggggaggggggaaaaacccgggggaaccacattattaaacccggt

SEQ ID NO: 34780 - protein, 85 aa, Zea mays
  misc_feature: Ceres CLONE 1413575-F
  misc_feature (2)..(86): Pfam Name: Ribosomal_L37ae Pfam Description: Ribosomal L37ae protein family
  misc_feature (40)..(40): Xaa is any aa, unknown, or other
  misc_feature (45)..(45): Xaa is any aa, unknown, or other
  misc_feature (55)..(55): Xaa is any aa, unknown, or other
MTKRTKKAGIVGKYGTRYGASLRKQIKKMEVSQHSKYFCXVCGKXAVKEKAVGIXGCKDCGKVKAGGAYTMNTARAAPSGARSAA

SEQ ID NO: 34781 - DNA, 752 bp, Zea mays
  misc_feature: Ceres CLONE 1413578-F
  misc_feature (642)..(642): n is a, c, t, g, unknown, or other
  misc_feature (752)..(752): n is a, c, t, g, unknown, or other
aaagctggagctccccgcggtggcggccgctctagaactagtggatcccccgggctgcaggaattcgcacgagaccattacctagaacatcctaatcgaaaactagtttcatttcctcctgttccagccgctcacccaagaaccggtcgtcaggagcttgggccgaccgagctattctattctccttgttccttttggccgttcgcccctttactccttctttgtttctttgtttctttttttttcctttcttgcatctggccgctagttactctttctctctttctgtttttttttgttctagcagctggccgctagtttctcttggctgacctctcttttctctctttttttttcgaaatctgttccggtttctgttcgtgtgcttagggttcacagaaccctaaactgttcttagttttcttatacctgatctgatcggttgtagtgatttctgccgagctctcagggataaaatccctttcattattttactgtttttttttaaaaaaatgaactcggttcatcagggtttctggaactcgattcgagttggggattctgtactaactcgtactccgagatcctctttctgtttggaactacaggagaaaacgacccccttccctccatcgtatagangtcttgataatattattattatttttttatttataccaccgcacagatcgaccatcggattttgtgaacccgagctctattattttctgtgaatgaaatttctgtacctn

SEQ ID NO: 34782 - DNA, 712 bp, Zea mays
  misc_feature: Ceres CLONE 1413579-F
  misc_feature: Encodes the peptide sequence at SEQ ID NO. 34783
  misc_feature (33)..(33): n is a, c, t, g, unknown, or other
  misc_feature (51)..(51): n is a, c, t, g, unknown, or other
  misc_feature (54)..(54): n is a, c, t, g, unknown, or other
  misc_feature (55)..(55): n is a, c, t, g, unknown, or other
  misc_feature (72)..(72): n is a, c, t, g, unknown, or other
  misc_feature (74)..(74): n is a, c, t, g, unknown, or other
  misc_feature (86)..(86): n is a, c, t, g, unknown, or other
  misc_feature (340)..(340): n is a, c, t, g, unknown, or other
  misc_feature (343)..(343): n is a, c, t, g, unknown, or other
  misc_feature (344)..(344): n is a, c, t, g, unknown, or other
  misc_feature (570)..(570): n is a, c, t, g, unknown, or other
  misc_feature (712)..(712): n is a, c, t, g, unknown, or other
aaagtggactcccgtggaaggggtgccctcctnaatccgtctcggggctgnggnntccaacgaccgaggagnanaactcctaatcnaaaagtcttctggaccgattatttctctggttggttccaagttccaacatgacaggcacgaaggcaagtcgagcagacagcaacatctagcacgaagcaccggccttgtacgcatcctcccttcgcatcgaggaatcgcgggcccaccgcggcaccaaggccccccgcattccgtcccgccgcggcgtcgctcccttgttctctcccgagccgtccgcgaaccaacccgtgctacctccgattcttcgcctcgncgnnctttctaccacctccgctccgcctggtcccgaacgagactagggaggttccagcgccgccggtgggggagatggcgctggagctgagcctggcctcggcttcgccgccggcgggcggcggcttggcgcagccgccgcccctcgccccacccgggaaggagcagcaagtggccggcgtggggattctactgcagatctccatgctcgtgctctcgttcgtcctcggncacgtcctgcgccgccaccgcttctactacctccccgagggcagcgcctcgcttctaattggcttaggtgttggtggcctcgctaatatttcaatacagagaccaacccaggacgtgggtcaacttccatgaaagagtcttn

SEQ ID NO: 34783 - protein, 95 aa, Zea mays
  misc_feature: Ceres CLONE 1413579-F
MALELSLASASPPAGGGLAQPPPLAPPGKEQQVAGVGILLQISMLVLSFVLGHVLRRHRFYYLPEGSASLLIGLGVGGLANISIQRPTQDVGQLP

SEQ ID NO: 34784 - DNA, 767 bp, Zea mays
  misc_feature: Ceres CLONE 1413580-F
  misc_feature: Encodes the peptide sequence at SEQ ID NO. 34785
  misc_feature (485)..(485): n is a, c, t, g, unknown, or other
  misc_feature (488)..(488): n is a, c, t, g, unknown, or other
aaagctggagctccccgcggtggcggccgctctagaactagtggatcccccgggctgcaggaattcgcacgagaccattacctagaacatcctaatcgaaaaccgcacacctctgacctccctccgtccatctcatcatcatctttgtccctctcgcgcaattcgccgaacacaccgcgcgcgcctcgcctcccagcgacggccgcctcgacggccaatgctggcggcgggatgagcgtggaggaggaggtggagcgcggggaggaggacctgttctacgagtcgctcgaccgcatcctctcctcgtcgggctcctccacctctgcctcggacgacgatggcgccgaccgcccgcgccaccgccgcagctgcgatgcgccagccgcagcggccctcgacctgtggacctcccagccggcgcccgtccatgagcggcggcgccggctgctccatctcatggggctcaccggcgatccttccctcgncgnatttgagaattgccgggtccgcctccggagaaagcgcgggaaccgcccccgggctctcccgtctcgtggtccaagttcagggggggccgcccctgggctccgcccggaagcccgcggttccggggggggccgtcttgcccttccctttgtccaaggggtccgaatgcgccaaacaagaaccccaggtgcctgaatagggaaccccaacaacggcaaaaaaaacccggggggagggaaaaaaattcccctcccccgagaggtcggaacgggggggccccc

SEQ ID NO: 34785 - protein, 149 aa, Zea mays
  misc_feature: Ceres CLONE 1413580-F
  misc_feature (85)..(85): Xaa is any aa, unknown, or other
  misc_feature (86)..(86): Xaa is any aa, unknown, or other
MSVEEEVERGEEDLFYESLDRILSSSGSSTSASDDDGADRPRHRRSCDAPAAAALDLWTSQPAPVHERRRRLLHLMGLTGDPSLXXFENCRVRLRRKRGNRPRALPSRGPSSGGAAPGLRPEARGSGGGRLALPFVQGVRMRQTRTPGA

SEQ ID NO: 34786 - DNA, 772 bp, Zea mays
  misc_feature: Ceres CLONE 1413584-F
  misc_feature: Encodes the peptide sequence at SEQ ID NO. 34787
  misc_feature (312)..(312): n is a, c, t, g, unknown, or other
aaagctggagctccccgcggtggcggccgctctacaatagtggatcccccgggctgcaggaattcgcacgagaccattacctagaacatcctaatcgaacttccgttcctgttcctctctattaaccagcaaggaaagcgccactctcaatccacctcaggcctcgctcagatctctccgcccgggtccatcttcccaccccaaaccttctcccgcctctctcgtcaacgccgaccgaggagagggatggtggtcttgcgggctccggccgcaacgctcctcttcctcctcgccctagcggcgggcgggggngtggcggccgacggctccgatcaccggaacaagattcgcgagcccgtcccgctctacgccaacaaggttggcccatttcacaaatcacagagaaaaatattccaaatttctacctgcctttctgctctcctgacaaaagagaaagaaaagaccccgcgcccttgggggaaggcccccaatggggatccgggtaaggtgatgcgcccttacatgttggatttcccgggacggaactgggcgccccagcggcgcttaggtccaaacaaaatcttacgaaccgagggaagtgactcgaaagtcccgcgagaaggaaggggctaaacggacaaccaactttcacaaatggtaccatagcaagaaccctgcccgctggggcggactttccatccgggaagaagttcgacacaaacgtatgcataccaaatcatcccacaacaccacttccaaactcccctaagct

SEQ ID NO: 34787 - protein, 128 aa, Zea mays
  misc_feature: Ceres CLONE 1413584-F
MVVLRAPAATLLFLLALAAGGGVAADGSDHRNKIREPVPLYANKVGPFHKSQRKIFQISTCLSALLTKEKEKTPRPWGKAPNGDPGKVMRPYMLDFPGRNWAPQRRLGPNKILRTEGSDSKVPREGRG

SEQ ID NO: 34788 - DNA, 640 bp, Zea mays
  misc_feature: Ceres CLONE 1413586-F
  misc_feature: Encodes the peptide sequence at SEQ ID NO. 34789
  misc_feature (498)..(498): n is a, c, t, g, unknown, or other
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgaacagcccaaactcaggatggtttgcnaaagatggaaccgtcttttgtctggggattacttttactcctttgcgtagaaattggagtggcagaagaatgggtgtatgtctttaaaagggaccgtgaggggagatatctggnatgcctttgatccactcccacagctatg

SEQ ID NO: 34789 - protein, 121 aa, Zea mays
  misc_feature: Ceres CLONE 1413586-F
  misc_feature (106)..(106): Xaa is any aa, unknown, or other
MDAASRPPPPHGAGVRVRAPLVESVSCYCRLDTGLKTVVEARKFVPGAKMCMQPEVKQNKRKSRGSKKERCRTQAPLLPGLPDDLAIACLIRVPRLEQPKLRMVCXRWNRLLSGDYFYSFA

SEQ ID NO: 34790 - DNA, 737 bp, Zea mays
  misc_feature: Ceres CLONE 1413587-F
  misc_feature: Encodes the peptide sequence at SEQ ID NO. 34791
  misc_feature (668)..(668): n is a, c, t, g, unknown, or other
aaagctggagctccccgcggtggcggccgctctagaactagtggatcccccgggctgcaggaattcgcacgagaccattacctagaacatcctaatcgaaaagaaaatcgatctgtccacatttcagccggacaccaccgtgtcgcccccgcgtcctaaacctctcacctcgccggggtccggtagccgcgaacgatgttccgccgcgcgctcctctcctccgtctccccactccacggaacggtacgaatcccgagccccagctattctcctatccaagcccttctcgctcaatggagcaggtacgcctccgtggtctcatcctcggccccgccgccgccgccgccccctccatctccgcctcaaggtccatcgaggtcgagcggtggaggtcccacttcctcgtcgctgaaccctgcagaggtcgccaagttcgcctccatcgccgagacctggtgggattctagtggcccattcaaacctttgcatgtgatgaatccaacccgactgtcttttatccgctccactctctgtagacatttcaggagggatccaaattcatctaagccacttgaaggtctcaaagttattgatgttggatgtggaggtggcattctgtcagagcctcttgctcgaatgggtgctacggttactgcaattgatgctgntgacaagatataaagattgcaagtattcatgcggcatctgatccaacactgcttctattgagtattgtg

SEQ ID NO: 34791 - protein, 62 aa, Zea mays
  misc_feature: Ceres CLONE 1413587-F
  misc_feature: SWISSPROT Homolog: EC 2.1.1.114 Hexaprenyldihydroxybenzoate methyltransferase
  misc_feature (59)..(59): Xaa is any aa, unknown, or other
MNPTRLSFIRSTLCRHFRRDPNSSKPLEGLKVIDVGCGGGILSEPLARMGATVTAIDAXDKI

SEQ ID NO: 34792 - DNA, 745 bp, Zea mays
  misc_feature: Ceres CLONE 1413589-F
  misc_feature: Encodes the peptide sequence at SEQ ID NO. 34793
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
ggcccccccaccccccccaannnaatatttattaccgtagacactctctccaaagctggcgctccccgcggtggcggccgctctagaactagtggatcccccgggctgcaggaattcgcacgagaccattacctagaacatcctaatcaaaagcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggcctgctcagcaatggtgactttgagacagcaccaagcggtgcttttgtaaaatctgcttctgttgctgagggtgcatcgtcaatccctggttggacgatcaacggcacggttgaactcatttcagcaggccaacaccagggtggcatgatcctgattgctccacagggggaccatgcagcaaggctaggcaattgatgctagcgttgggcaggtggggggacgtctgagaaggcgttcggaggatggtatcacaattcagtgctggcccggacattgtgcaccaactggaaggcaactgaaatgtttcccgtggctaagtcgggcggtgtcctcaaa

SEQ ID NO: 34793 - protein, 97 aa, Zea mays
  misc_feature: Ceres CLONE 1413589-F
MEADSARKRLALLALLLLAAPVRPASAAPVEDGLLSNGDFETAPSGAFVKSASVAEGASSIPGWTINGTVELISAGQHQGGMILIAPQGDHAARLGN

SEQ ID NO: 34794 - DNA, 665 bp, Zea mays
  misc_feature: Ceres CLONE 1413590-F
  misc_feature: Encodes the peptide sequence at SEQ ID NO. 34795
atagctggagctccccgcggtggcggccgctctagaactagtggatcccccgggctgcaggaattcgcacgagaccattacctagaacatcctaatcgaaaaatcacaggcctcccggcctcccgtgcgctattctctatcagcttacccagcacacagtacacactctaatctccacacgacccaatagatatacggggctgaaggatgaagcttagagcaaaagggatcggcctcctgcttctccttgtcttgcttgctctttgctccaccattgaagtcggcgaggcaagaagaggcaagcattggaggtcgtcgaggagctcaccgggctcatcccagctcaagaaagacaagggaaagaagagcagctcccgccggcagtacggcgccaaccggccaggcccgaagccaccggtcagctcgacaccaagctctggtgctgccaagggaaatcatcagaaatccttacaacccaagcccaagcccaagcccgattgccccctgaaatcccttcctaatcccaagccctggcccaatggaaacaaggcaattcccttcccccaacccgccgggttcccaaggtgggggggaagggggaaagaaagaggcccattcaaagccccgccgcccagggacccccccgagagggtgggagttaatct

SEQ ID NO: 34795 - protein, 152 aa, Zea mays
  misc_feature: Ceres CLONE 1413590-F
MKLRAKGIGLLLLLVLLALCSTIEVGEARRGKHWRSSRSSPGSSQLKKDKGKKSSSRRQYGANRPGPKPPVSSTPSSGAAKGNHQKSLQPKPKPKPDCPLKSLPNPKPWPNGNKAIPFPQPAGFPRWGGRGKERGPFKAPPPRDPPERVGVN

SEQ ID NO: 34796 - DNA, 744 bp, Zea mays
  misc_feature: Ceres CLONE 1413594-F
  misc_feature: Encodes the peptide sequence at SEQ ID NO. 34797
aagctggagctccccgcggtggcggccgctctataactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccacagcacccggagctggccttccaggagaccgaaccagggcgctcgtgcgcgcccagttcgacgcgatcgggggcccggacgcccgggcccggcccgaaaaaaggggggttgggggccaccaataccggggccccgcggggggccccggggttccccgccccgccccccaaatgggacgcccccccccctcccggaaaaaggggaaaaaaggggggcttccaaaaaccacggaaaaaaccgaaaatagggggggggggggggaccaaaaaccccccacgggggggaggctcttttctgggaaacaaaaaagggtgttttctcacctcctcggggggggcgccttttaagggggggggcgggaggggtttttttggcgggggcggtttttttttgggcca

SEQ ID NO: 34797 - protein, 113 aa, Zea mays
  misc_feature: Ceres CLONE 1413594-F
MAAAPALARELLDAAREPEFAEWQRGVRRRIHSTRSWPSRRPNQGARARPVRRDRGPGRPGPARKKGGWGPPIPGPRGGPRGSPPRPPNGTPPPLPEKGEKRGASKNHGKNRK

SEQ ID NO: 34798 - DNA, 708 bp, Zea mays
  misc_feature: Ceres CLONE 1413606-F
  misc_feature: Translation starting site: 181
  misc_feature (470)..(470): n is a, c, t, g, unknown, or other
aaagctggagctccccgcggtggcggccgctctagaactagtggatcccccgggctgcaggaattcgcacgagaccattacctagaacatcctaatcgaaaaatttcggccacaccctccttgcctccacggctccacccctgcttcaggttacctgtgccagcgacgccggtagaagccatggacagctctctcgcgagcgcggcggcgatagccgatcagcgccagaagatcgagcagtaccgccacatcctcgcctccgtcctctcgtcttccccaccggacatctctcaggccaagcgcttcctcgaccacatggtttcggacgaagttccgctcgtggtgtcacgtcaattgctccagacgttcgcaggacctactgcagctggagtcggacgcgcagaaggaggttgcacactacgcgctcacgcagatccagccgcgtgtggtctcatacgaggagcacgtgntagtgattaaagaggagcttgcagagctatatgagtctgaacaacaatggtgcaaaggcagcccaaatgctttaaggggcattgactttggaattcagaaaccggaatggttggggacaccaccaaatatcccaggggggttaaaatggaacggttcccttttaaccgttatttatccgtggagggctgaggttttttaaaacaaggttttttttttgggccccaaccccccttcgga

SEQ ID NO: 34799 - DNA, 754 bp, Zea mays
  misc_feature: Ceres CLONE 1413607-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (30)..(30): n is a, c, t, g, unknown, or other
  misc_feature (33)..(33): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (62)..(62): n is a, c, t, g, unknown, or other
gtgtggcccccnnnnnnnnnnntcccnccnttntccgggggtgnnngnnnnntcagagtggnactccccgcggtggcggccgctcatacactagtggatcccccgggctgcaggttttcgcacgagcaccattacctagaacatcctaatcaaaaaacgtgaactcccccgacgactcagtgcgtcttcgccgccgttttcgtcgtcgcagattagggttcccctcctctaacacgccggcgcttccccccctgccaccgcgacactcagtcgtcgccgccgtcgggtctgctgccgtggacaagcgcgttggcagcgaggattgctttagcttgcaggcactttccccacccccaacgccgatgatttcgccgttatgcggtgaagcccttcgcgctgacgggctaatcggctggatgatttctatgtatgatggggtaggagtgctcctggttcgcgcctcggaggaccctcgccgtctatcgatccagtgatgtggagctcacctttctccgcgtagcgttgtgtcatggggagagggcttgttgatccctcggggagccggctgagttgtctttcgtttgcgggaaaactgtgcggcacgcgcaaggttggttgattcgaaatggtacccgggcgggggaatcatattggtgggacatcaaggtccgtatgagggaggagtttgatgatccgggcactgtcccataaaataaaacggcctaagaacccccgccggacacccgtgtgaacg

SEQ ID NO: 34800 - DNA, 733 bp, Zea mays
  misc_feature: Ceres CLONE 1413609-F
  misc_feature: Encodes the peptide sequence at SEQ ID NO. 34801
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (31)..(31): n is a, c, t, g, unknown, or other
ggccgccccgcgcgtnnnnnntccattcaanaataaaaaccctacgcccaaagctggaactccccgcggtggcggccgctctagaactagtggatcccccgggctgcaggaattcgcacgagaccattacctagaacatcctaatcaaaaactcgcaatgtctacttgtctaccgtcgctgcgctagccctcctccctgcttcttgcttttgcctgagcctgcagcctgctgcaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcacccctcgcgtttctttgctcaattgggggtcacggtcacggcccgcgggtgctgcgcgtgctcgtgggcgcgcggaattcggggttcttgcgcggtcccggtcccctcggcgattgcggacgctctctgcagatcttcgcgtaactccgggagcgcgccggagatgaactgcgggccgcccgaccagctgccgccggggtcgggcgccgtcgtgcttcctcaacctgaactgggaccagtctatggccgccgaccagctcgacccggcgctcagttcgatggtctccctcccccggcgtccaactcgacggccgcccaccgcggttactgaacggccgcgctctccacggggatc

SEQ ID NO: 34801 - protein, 37 aa, Zea mays
  misc_feature: Ceres CLONE 1413609-F
MAADQLDPALSSMVSLPRRPTRRPPTAVTERPRSPRG

SEQ ID NO: 34802 - DNA, 685 bp, Zea mays
  misc_feature: Ceres CLONE 1413613-F
  misc_feature: Encodes the peptide sequence at SEQ ID NO. 34803
caagctggagctccccgcggtggcggccgctctagtactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagaagcggcggcgacggatgaggaggaggctggcggcatgctactcatcgagacctgctgccggcaccgctcaaggccagtgtcagtgcggctcctctagccccggtggcggcggcgtaagcggcagcctcatggcaagaacaccgcgcgcgttctcgagctgctccagctacgccgcctcgtctgcctgcacgccggcggcggccgtccatctcggcacccagcacaagctgacggcgctcctcgacgcgctcgcgctcctcctcgtcctccctcgacctcctctcgtggcaggggtcccggtggtggctccccgcacgatggcgaggatccgcaaccacatggagaggatcaacaagacccccgtgcgctccattgagagccaggacggcgacaccatcgactgcgtggcggcgcacgagcagcacggcctggaccacccagctctcatggcgcacgacatcca

SEQ ID NO: 34803 - protein, 48 aa, Zea mays
  misc_feature: Ceres CLONE 1413613-F
MARIRNHMERINKTPVRSIESQDGDTIDCVAAHEQHGLDHPALMAHDI

SEQ ID NO: 34804 - DNA, 745 bp, Zea mays
  misc_feature: Ceres CLONE 1413621-F
  misc_feature: Encodes the peptide sequence at SEQ ID NO. 34805
  misc_feature (13)..(13): n is a, c, t, g, unknown, or other
  misc_feature (242)..(242): n is a, c, t, g, unknown, or other
cacaaaaaacccncacccccaaccccaccccccccataaaaaaatgccctcaaccacactggcgctccaccgcggtggcggccgctctataactagtggatcccccgggctgcaggaattcgcacgagaccattacctagaacatcctaatcgaaaaacttctcgttctcgccgatccagtgccactacactacaatactgctgcgcgctagcggtagcgctcgcgctcccactcgcaccanagcacgccaccgctgctgccggctcctccccgcgctcgcattgcgatttgcgacctagcgagagggtaccgggggtggtgcgcgtgctccgtgatccagaaagcgccgcgagatggccggtggcggaggcggcggtgccgcgccgaagtacgacgacttcacgccgcaccccgtcaaggaccagctccctggggtctcctactgcatcaccagccctcccccgtgacctgaagcccttcttcttgcgctccaacattatctggacatgcttggtaccactgtgatcataccaaactgcacttgttccccaaatgccaggcaaccaacgaggacaaaggcagtgcctatcccgaacattgcctggtccctagcaaagtatctaccccccctccctgccacatgtttcttctgcccaaccactgttacccctgccacgagaatccgacgtgtttctacacacacccttttggcatcctggcctaaacccatttttcagaattcat

SEQ ID NO: 34805 - protein, 37 aa, Zea mays
  misc_feature: Ceres CLONE 1413621-F
MAGGGGGGAAPKYDDFTPHPVKDQLPGVSYCITSPPP

SEQ ID NO: 34806 - DNA, 757 bp, Zea mays
  misc_feature: Ceres CLONE 1413622-F
  misc_feature: Encodes the peptide sequence at SEQ ID NO. 34807
  misc_feature (633)..(633): n is a, c, t, g, unknown, or other
  misc_feature (634)..(634): n is a, c, t, g, unknown, or other
  misc_feature (695)..(695): n is a, c, t, g, unknown, or other
  misc_feature (747)..(747): n is a, c, t, g, unknown, or other
caaagctggagctccccgcggtggcggccgctctagaactagtggatcccccgggctgcaggaattcgcacgagaccattacctagaacatcctaatcgaaaaatttcccaccttcccaaacgccacttaaaagagaaaggagagcatcgcagtggcacacgcgcaatggaaggctcgccggtgacgcgcctcccggaggctaactccctccccgacggcttcgttcccgactccgagagccctggcacggacgcgacgtttcccttctccgcgcccatcgttgatgatgcgctcaactccgatatccccgccgcgaccaacccaggcggcgaggaaaccctaaacgatccccccctccctgcgtccagcgccgaagatgcctcctcggccgccgctgctgaagccttgggcacactttctctggacgctgccgccgagccagaacgcgctctagaggagaacggacccaccggcgctgcaagaggtgaagcatccttgaagaattgtgcatcagagctagtgggcgctccaactgctcaaaaagggagcgttgagccgaaacgtaaggttgtgaaacgtagcaagcttgagaaggacagagagttgtttgaactggcccagcaataccatannagtgttgcagaaagggatgcagccattgggagtaaagaaaactagaatctctttgtagggnagttcagcgtcaaaacaaatgctaaaggaagagtgcccaagggtgtcgacgnagggacagaa

SEQ ID NO: 34807 - protein, 170 aa, Zea mays
  misc_feature: Ceres CLONE 1413622-F
  misc_feature (156)..(156): Xaa is any aa, unknown, or other
MEGSPVTRLPEANSLPDGFVPDSESPGTDATFPFSAPIVDDALNSDIPAATNPGGEETLNDPPLPASSAEDASSAAAAEALGTLSLDAAAEPERALEENGPTGAARGEASLKNCASELVGAPTAQKGSVEPKRKVVKRSKLEKDRELFELAQQYHXSVAERDAAIGSKEN

SEQ ID NO: 34808 - DNA, 738 bp, Zea mays
  misc_feature: Ceres CLONE 1413629-F
  misc_feature: Encodes the peptide sequence at SEQ ID NO. 34809
aaagctggagctccccgcggtggcggccgctctagaactagtggatcccccgggctgcaggaattcgcacgagaccattacctagaacatcctaatcgaaaaaagtcgcgtgctgctttcttctctcgttcacctcgcgtgcgcgaaccaactagggcgaccgctgccgccctacggcctacgcccagctgctcaggtcttattcgggcctttggcggcgagaaccgaccgcgccaggataatggctcaccgtggacacctagatggactgactgcccaagctccagcactgatgcgccatggttccttcgctgcaggcagcctttctagccactcacctttggagtcttcatctacactggagatgctggagaacaagcttgccatgcaaactgcagaagtggaaaagcttatcatggagaatcagcggttagcatcaagccatgtggtctttgagcaggacattggtgatacagagaagagatgcaaataaccgcactcccctaagtggaagttcaacggaaactgatttgcatataagaaattttttggaaaaaattaaattaaggggggcaaactccctagggggggaggcggagaaaaaaggccttccccaggggctttgggggggcaaaaaattttttttgggaaggggaaggttgccccccttgaaaagggggtggggcaaaaaaataaaaaaaaccctctcccctggggggaaaaaaaaactccttcaat

SEQ ID NO: 34809 - protein, 83 aa, Zea mays
  misc_feature: Ceres CLONE 1413629-F
MAHRGHLDGLTAQAPALMRHGSFAAGSLSSHSPLESSSTLEMLENKLAMQTAEVEKLIMENQRLASSHVVFEQDIGDTEKRCK

SEQ ID NO: 34810 - DNA, 715 bp, Zea mays
  misc_feature: Ceres CLONE 1413644-F
  misc_feature: Encodes the peptide sequence at SEQ ID NO. 34811
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
aaaaccccaaccnnnnccccccctctttgttttgtannaagcannnnnntccaaagctggagctccccgcggtggcggccgctctagaactagtggatcccccgggctgcaggaattcgcacgagaccattacctagaacatcctaatcgaaaaatataagcacggcggggtggaaccggacgtccctcgctcccaaatatctctccccacctcccctgagcttctcccgacctttggtcaggcaaaggaggcggccaacaaggacgagcgatggtgaccaaggtcatctgcttcctggtgctcgcatccgtgctcctcgccgtcgcttttcccgtgtctgctctgcggcagcaggtgaagaagggcggcggcggtgaaggcggaggcggaggcagtgttagcggaagcggaggcggcaacctgaatccctgggagtgctcgcccaagtgcgggtcgcggtgctccaagacgcagtacaggaaggcctgcctcaccttatgcaacaagtgctgcgccaagtgcctctgcgtgccaccggggttctacggcaacaagggcgcctgcccctgctacaacaactggaaaaccaaggaaggagggcccaagtgcccctagaagatccaccgcagctcccgtccgccattgtccccccttctccgaatctggaacgtgttgttcatcttccaccaccccctaggcttggcattttattat

SEQ ID NO: 34811 - protein, 114 aa, Zea mays
  misc_feature: Ceres CLONE 1413644-F
  misc_feature (2)..(114): Pfam Name: GASA Pfam Description: Gibberellin regulated protein
MVTKVICFLVLASVLLAVAFPVSALRQQVKKGGGGEGGGGGSVSGSGGGNLNPWECSPKCGSRCSKTQYRKACLTLCNKCCAKCLCVPPGFYGNKGACPCYNNWKTKEGGPKCP

SEQ ID NO: 34812 - DNA, 685 bp, Zea mays
  misc_feature: Ceres CLONE 1413646-F
  misc_feature: Encodes the peptide sequence at SEQ ID NO. 34813
  misc_feature (397)..(397): n is a, c, t, g, unknown, or other
  misc_feature (421)..(421): n is a, c, t, g, unknown, or other
  misc_feature (422)..(422): n is a, c, t, g, unknown, or other
  misc_feature (432)..(432): n is a, c, t, g, unknown, or other
  misc_feature (521)..(521): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaaaagcttaccgtctccaccgcatctcatctcgccggcgagccagcctaaccaatcgccaatgctcacctcgttgcttccaccgcccaccgtcccgatctccaaaccctccgcgtcggcgtcgcccaagaccgccaagcccaggtccgccgtgctctccgcctccgccctcgccctcgcccccgcctcgacatccgattccgacgatgcgcccggcgggggcgagggcggcggcgtccgcctctcctcgctcatccgctccctctgcgccgcggggcgcacagcagaggccgcgcnggcgctgtcccgcgcgggcggcgnncgcggcgtcntcgcctacaacgccatggtgggccgctactgccgcgcgggccagctcgaatccgcgcgccggcttgcccgcggggtccccgtccggccnaagncttaccctacttccccgtcgtccgggccttctgggggggggcggatccccaaccccctccgggggtcaaaaaaaggcccccccgggttgggccccatcccgccctggaaccggtattcccaaggcccttggaggtggggggttcccaaacccccaggggt

SEQ ID NO: 34813 - protein, 174 aa, Zea mays
  misc_feature: Ceres CLONE 1413646-F
  misc_feature (79)..(79): Xaa is any aa, unknown, or other
  misc_feature (87)..(87): Xaa is any aa, unknown, or other
  misc_feature (91)..(91): Xaa is any aa, unknown, or other
  misc_feature (122)..(122): Xaa is any aa, unknown, or other
MLTSLLPPPTVPISKPSASASPKTAKPRSAVLSASALALAPASTSDSDDAPGGGEGGGVRLSSLIRSLCAAGRTAEAAXALSRAGGXRGVXAYNAMVGRYCRAGQLESARRLARGVPVRPKXYPTSPSSGPSGGGRIPNPLRGSKKGPPGLGPIPPWNRYSQGPWRWGVPKPPG

SEQ ID NO: 34814 - DNA, 764 bp, Zea mays
  misc_feature: Ceres CLONE 1413653-F
  misc_feature: Encodes the peptide sequence at SEQ ID NO. 34815
  misc_feature (47)..(47): n is a, c, t, g, unknown, or other
  misc_feature (48)..(48): n is a, c, t, g, unknown, or other
  misc_feature (403)..(403): n is a, c, t, g, unknown, or other
  misc_feature (542)..(542): n is a, c, t, g, unknown, or other
  misc_feature (595)..(595): n is a, c, t, g, unknown, or other
  misc_feature (684)..(684): n is a, c, t, g, unknown, or other
gtggccccccccccccccccccatggagccaaaaaatttgttttttnngggtcaaactggcgctcaccgcggtggcggccgctctattactagtggatcccccgggctgcaggtattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcaagcgactgacgggcggacggtcccgccggctatggggaactgctgctccgatgaggtgagccacgccggtgctcatcccgtcggttcccggcaccgccaaagcgggctccgcagcctccgccgcgggcgatcgntttgtccgctcccgtggtgacggcgcgtccgcgcagagggagggatctctctctgcatcccctcccgcgatcaagaatattttcccgggagcaatccccctgcggcctgtgtattccccaccgaaaaatgggtctctanaagaagttggggggcaccgcaacgactcttaaccttattgaacccatctttgnagtatccaaaatccttgtcgccgtcacccaaaaataagcgttcttcagaatttgcggggtttcagggtctcttgaccgtcccgcccccncactccccccgactgctcgcatgtacccgcacggctccactccccaccgggcatccacgagctcccccctccgaagcccc

SEQ ID NO: 34815 - protein, 33 aa, Zea mays
  misc_feature: Ceres CLONE 1413653-F
  misc_feature (4)..(4): Xaa is any aa, unknown, or other
  misc_feature (22)..(22): Xaa is any aa, unknown, or other
MGLXKKLGGTATTLNLIEPIFXVSKILVAVTQK

SEQ ID NO: 34816 - DNA, 679 bp, Zea mays
  misc_feature: Ceres CLONE 1413656-F
  misc_feature: Encodes the peptide sequence at SEQ ID NO. 34817
aaagctggagctccccgcggtggcggccgctctagaactagtggatcccccgggctgcaggaattcgcacgagaccattacctagaacatcctaatcgaaaatttatctcggccaacgtggacggcgcgtgattttctcttctctcgcagtcgcagcacggcagtcggcagcaggcaggcagccagccagcagccagcagctgcgaatcgaagcggaatcgaagcccaccaccagcagcagtgcccacttgcttggagcgcgagtttaccccgagcaaatcgcggtggcgctcgtgcccgtgcctcccgcgtcgaaccctagtgcaactaccagatccggagatcccgcgcgggcgcgggcggaacaccaagcttctgactcaactcaatccccgcacctgccaatgccaccccctcggcgctgatccgatcccgccgccgccgacactcgcgggcccgccccatggattccgcccggagctggctccagaagctgcagccgcgggacaaggacagagagcggggcgccaagacgctcggcgccggcgtcgcccaacggtgacgccggcaactccgcgaggatggccgccgcggcggaggaggaagcgctgtctagcgccaccaagcagaaggtggcggcggcgaagcagtacatcgagaaccactacaagtcgcagag

SEQ ID NO: 34817 - protein, 32 aa, Zea mays
  misc_feature: Ceres CLONE 1413656-F
MAAAAEEEALSSATKQKVAAAKQYIENHYKSQ

SEQ ID NO: 34818 - DNA, 682 bp, Zea mays
  misc_feature: Ceres CLONE 1413662-F
  misc_feature: Translation starting site: 393
aaagctggagctccccgcggtggcggccgctctagaactagtggatcccccgggctgcagggaattcgcacgagaccattacctagaacatcctaatcgaaaaagacagacgcagactctctcacccgactcgtcagacgtcagccagcagttcgaaaccaaggattgatccaggagcttccggaaggcgaggtgcgcgcgcagcgtctaggtgctggtggcgttgccgcccatggttcggggtcgcgtatccgcggtcctgctcggcgtcctgctcgcaggatccttgtgcgcgttttcagttgccaaagaggagaccaagaagctcgcgaccgtgatcgatatcgatctcggtaccacctactcctgtgtcggtgtgtacaataacggtcatgacgagatcgtcgcctgtgaccagcgtaaccgtatcacacccctcatgcgttgccttcaccgatctcgagaggctcatcgatgagggtgccaagaaccaggcagccgtcaaccctgacaggaccatctgtgacgtcaagcgtctcatcgcaagagagttcgcggacaaggaagtccagagggacatgaatcttgttccctacgatattattaacaaggatggcaagtcctacattcaggtctagatctaggatggggagaacaatgtcttcagctcctgaggagatca

SEQ ID NO: 34819 - DNA, 650 bp, Zea mays
  misc_feature: Ceres CLONE 1413665-F
  misc_feature: Translation starting site: 160
  misc_feature: SWISSPROT Homolog: EC 2.5.1.8 tRNA isopentenyltransferase
  misc_feature (435)..(435): n is a, c, t, g, unknown, or other
aaagctggagctccccgcggtggcggccgctctatcactagtggatcccccgggctgcaggaattcgcacgagaccattacctagaacatcctaatcgaaaacattgaatttgtccgagtaacaaaatcgtgtctgcttttaattcctgacatttacagatggcccacccctccgacgccgacgtatcctccacgatgctcgttgcaaaccctaactctggagccagcaaagaaggaggcgcctgctctccgtcgtggccttctcaaaggtgctggcccaaggtggtgatcgttatgggcgccacgcccgccgagaagtcgcgggtggtcgtcgaccatcacgcccacttcggcaccttcgagtcgctcagcgccgactcgatgcaactctaccgcgggctcgaagtgctcagcagacaggctcacctccacgangcgaacgagtgtccctcatcatctacttagggtgattgatccctctgtcgagttcacttgacgcgatttcggcgatcgcggcctggcgaattaaccggaaaataggggacccgggaggcctcccctggagtttggcggggggccaaaatttcaaaatccggggtttccgaaaaccgttccctcttggggggatttggcgaaaaaaatcgctgggg

SEQ ID NO: 34820 - DNA, 662 bp, Zea mays
  misc_feature: Ceres CLONE 1413669-F
  misc_feature: Encodes the peptide sequence at SEQ ID NO. 34821
  misc_feature (652)..(652): n is a, c, t, g, unknown, or other
ggagctccccgcggtggcggccgctctatcctagtggatcccccgggctgcaggaattcgcacgagaccattacctagaacatcctaatcgaaaaatcctcagtgctctctctctcctactcctgtgattctcctcttcagctcttctcgcccattccagctccgactgcgccggtgggggaccgcgcaccccagcggcgccaggcgtccacgggatggtggttcttgtggctactgccgctcggtggcccgggggaagcacggctgcccgggcgcgcccgccggctgcgaggggcagggcccccctccgcgtcgccgccgagcccgagcacagggcggccacggtcaggtttggtacgcgccattggaagaaaaccagtagctgtcgcgaccttttttgatgtttcgattgcttcgttcacctgcgcactagatcaccgccttccttcaggtcgctggacctccattatgttatgcctgacaggcgcaaccataagcaattctaattgcatcttgatagaccaattccaggctaagatagcgcgagaattagggacactgtggcagcaagttatggatactgaacactagtgttgcagtttctttcccacttcttgatgtaacatttggttacacattcctttttttttgnagccataacg

SEQ ID NO: 34821 - protein, 61 aa, Zea mays
  misc_feature: Ceres CLONE 1413669-F
MVVLVATAARWPGGSTAARARPPAARGRAPLRVAAEPEHRAATVRFGTRHWKKTSSCRDLF

SEQ ID NO: 34822 - DNA, 682 bp, Zea mays
  misc_feature: Ceres CLONE 1413674-F
  misc_feature: Encodes the peptide sequence at SEQ ID NO. 34823
  misc_feature (272)..(272): n is a, c, t, g, unknown, or other
  misc_feature (336)..(336): n is a, c, t, g, unknown, or other
  misc_feature (342)..(342): n is a, c, t, g, unknown, or other
  misc_feature (345)..(345): n is a, c, t, g, unknown, or other
  misc_feature (346)..(346): n is a, c, t, g, unknown, or other
  misc_feature (351)..(351): n is a, c, t, g, unknown, or other
  misc_feature (353)..(353): n is a, c, t, g, unknown, or other
  misc_feature (354)..(354): n is a, c, t, g, unknown, or other
aagctggagctccccgcggtggcggccgctctagaactagtggatcccccgggctgcaggaattcgcacgagaccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctncatggtgctggtctttgtcctgctagtagatcatttagcacccaggctggcactacgtcaaggnacacanagnnctcancnntcacacccccctcagagaagactcactttggtggtctcaaagatgaggatcgcattttcaacaacctctatggtctgcatgacctttttctgaaagcgcggtgaaaaaaggggactggaataagaccaaggatttggggattaagggggcaaactgggatggtaatggaatgaaaaaaaccgggcctccggggccggggaggggccgggttttcccccccgggcgagaaagggccctttatggcccaaggttttgggggggaccccccctcttaaattggggggaaaagggggaaaaaaaaagggcccccgggaaatttggaaaaaaa

SEQ ID NO: 34823 - protein, 97 aa, Zea mays
  misc_feature: Ceres CLONE 1413674-F
  misc_feature (58)..(58): Xaa is any aa, unknown, or other
  misc_feature (60)..(60): Xaa is any aa, unknown, or other
  misc_feature (61)..(61): Xaa is any aa, unknown, or other
  misc_feature (63)..(63): Xaa is any aa, unknown, or other
  misc_feature (64)..(64): Xaa is any aa, unknown, or other
MALRRALLRSVNFSPDSKAAIEYFYSFSRAQSACSLHGAGLCPASRSFSTQAGTTSRXTXXSXXTPPSEKTHFGGLKDEDRIFNNLYGLHDLFLKAR

SEQ ID NO: 34824 - DNA, 671 bp, Zea mays
  misc_feature: Ceres CLONE 1413678-F
  misc_feature: Encodes the peptide sequence at SEQ ID NO. 34825
acagctggagctccccgcggtggcggccgctctagaactccccggatcccccgggctgcaggaattcgcacgagaccattacctagaacatcctaatctaaaaagggagggcgccaattgcggtggccaccacttccaatccactccccgtgttcgcctcgccgagctgttcttgctctgtcctctctccaactccacgatttgttccacacccggttcccgagcctccgcagcgcttcttgctgaaaaagggaactccgagttctccagctctggatcggcagagagcggtggttccttttgcggactctgaggtccagttcttgtttttgatttgtctcatcaacccaccagtcgggctgcaggcttacagctgcaaggaatagtttgactagagaaatggggcagtgttgcagcagagctacggccccggactctggacggggaggtgccaatggttatggctattctaaccaggcaaaagcggcgcaagcacctccgaaagtacaccctcctcagccagcggccgaggtgaggtacacaccatcggcgacgaactcttcggcagtcccacccgtggctgttgccgccgaaccaacggcggacacgattcttggcaagcagtaacgagacgtgcgctctgtctactccctcgggaaagagcttggccg

SEQ ID NO: 34825 - protein, 75 aa, Zea mays
  misc_feature: Ceres CLONE 1413678-F
  misc_feature: SWISSPROT Homolog: EC 2.7.11.1 Non-specific serine/threonine protein kinase
MGQCCSRATAPDSGRGGANGYGYSNQAKAAQAPPKVHPPQPAAEVRYTPSATNSSAVPPVAVAAEPTADTILGKQ

SEQ ID NO: 34826 - DNA, 725 bp, Zea mays
  misc_feature: Ceres CLONE 1413684-F
  misc_feature: Encodes the peptide sequence at SEQ ID NO. 34827
  misc_feature (197)..(197): n is a, c, t, g, unknown, or other
  misc_feature (245)..(245): n is a, c, t, g, unknown, or other
  misc_feature (246)..(246): n is a, c, t, g, unknown, or other
  misc_feature (281)..(281): n is a, c, t, g, unknown, or other
  misc_feature (282)..(282): n is a, c, t, g, unknown, or other
  misc_feature (296)..(296): n is a, c, t, g, unknown, or other
  misc_feature (317)..(317): n is a, c, t, g, unknown, or other
  misc_feature (318)..(318): n is a, c, t, g, unknown, or other
  misc_feature (347)..(347): n is a, c, t, g, unknown, or other
aagctggagctccccgcggtggcggccgctctagcctagtggatcccccgggctgcaggaattcgcacgagaccattacctagaacatcctaatcgaaaaagttccatcccaatcgccgagaaggggaagccaaatcgatggcggcggcggcggccggcgacgagaacagcggcgcggggcgcggcgcgggcgaggncgagttctacctgcggtactacgcacaccggccggtgaccctgggtgnngtgctctctctctctctctctctctccccctccgnnatccgtggatcgtncacgccgcccggcccgggggnnagcgccgcgcgccacctgagggcaggggnagccagcagccgctgctccaccaaggggggcgcgccgctttttgaagcgcttatgcccccgggcccgctgaggcttagggcagttttttggaaaatgaaaccccctaggaggggaaaaaagactggggcccccaataacgggaaaaaggggggggtttctggacaagttggcatgggaaatggccaaaggtggggcccccggcgaaaacccttttggggggggggggaaacaaaccccccttggtggacgcggaaacacccgggggggggggggcccccaaaaagaaattgtgggcgccacccccttttaaaaaggggggggggcggggggccccaaaaaagaaaggggggcgcggtccccccgcaggggggaagggg

SEQ ID NO: 34827 - protein, 195 aa, Zea mays
  misc_feature: Ceres CLONE 1413684-F
  misc_feature (20)..(20): Xaa is any aa, unknown, or other
  misc_feature (36)..(36): Xaa is any aa, unknown, or other
  misc_feature (48)..(48): Xaa is any aa, unknown, or other
  misc_feature (53)..(53): Xaa is any aa, unknown, or other
  misc_feature (60)..(60): Xaa is any aa, unknown, or other
  misc_feature (70)..(70): Xaa is any aa, unknown, or other
MAAAAAGDENSGAGRGAGEXEFYLRYYAHRPVTLGXVLSLSLSLSPSXIRGSXTPPGPGXSAARHLRAGXASSRCSTKGGAPLFEALMPPGPLRLRAVFWKMKPPRRGKKTGAPNNGKKGGVSGQVGMGNGQRWGPRRKPFWGGGETNPPWWTRKHPGGGGPPKRNCGRHPLLKRGGGGGPQKRKGGAVPPQGGR

SEQ ID NO: 34828 - DNA, 681 bp, Zea mays
  misc_feature: Ceres CLONE 1413685-F
  misc_feature: Encodes the peptide sequence at SEQ ID NO. 34829
  misc_feature (364)..(364): n is a, c, t, g, unknown, or other
  misc_feature (553)..(553): n is a, c, t, g, unknown, or other
  misc_feature (574)..(574): n is a, c, t, g, unknown, or other
  misc_feature (575)..(575): n is a, c, t, g, unknown, or other
  misc_feature (599)..(599): n is a, c, t, g, unknown, or other
  misc_feature (600)..(600): n is a, c, t, g, unknown, or other
  misc_feature (616)..(616): n is a, c, t, g, unknown, or other
  misc_feature (650)..(650): n is a, c, t, g, unknown, or other
  misc_feature (676)..(676): n is a, c, t, g, unknown, or other
aagctggagctccccgcggtggcggccgctctagaactagtggatcccccgggctgcaggaattcgcacgagaccattacctagaacatcctaatcgaaaaatcgagctgtcccctccctgtgctcttgcgccttgctagcttgcttgcttccctgctccctccctcctcttcctcgtcgcctcttctctggttcttcctggtgtttgccggagcgaggctaggcgcaaggggaggtagctgcgatcagccagagctcatcggcgctacgcaagcgcgctgcctggtgtgctgcactgccgaactatcaggggaaaacactgaaataatggaaatcagcttattgcataatgaatctgatgcangaagcaccagtttgctaccgctgccattgttgtcatatggcccaagatcaatggttccaatacaagtaccaccatcatcagactttgagagtatcctgtcaccagagccaatctacagtgatcttcagttgaaagagatgaactacaatgcagcagcaatggatgaaagcactgagttccttcacttgnatcttaggggcaatgatgaanngatacatagcacaactgaattacnnagttgggatggtgcgnacttctatgtctcagaaacttttctgctctcaantgtgatagtttgatgggttttacaantgaag

SEQ ID NO: 34829 - protein, 111 aa, Zea mays
  misc_feature: Ceres CLONE 1413685-F
  misc_feature (13)..(13): Xaa is any aa, unknown, or other
  misc_feature (76)..(76): Xaa is any aa, unknown, or other
  misc_feature (83)..(83): Xaa is any aa, unknown, or other
  misc_feature (91)..(91): Xaa is any aa, unknown, or other
  misc_feature (97)..(97): Xaa is any aa, unknown, or other
  misc_feature (108)..(108): Xaa is any aa, unknown, or other
MEISLLHNESDAXSTSLLPLPLLSYGPRSMVPIQVPPSSDFESILSPEPIYSDLQLKEMNYNAAAMDESTEFLHLXLRGNDEXIHSTTELXSWDGAXFYVSETFLLSXVIV

SEQ ID NO: 34830 - DNA, 616 bp, Zea mays
  misc_feature: Ceres CLONE 1413688-F
  misc_feature: Encodes the peptide sequence at SEQ ID NO. 34831
  misc_feature (461)..(461): n is a, c, t, g, unknown, or other
  misc_feature (515)..(515): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcccctacgacgacgacgcatcgggacatggcccgcttcgcgacacgctgtcggacacctccccggctcgccgcgcaangcttcgtgttcgaagacggcgtcatcaactcgccgcccgcggttgcttggcggnggnaacttgaatcaaacgccgggtttctaaacgcggggccaagggaacaaataactgggggggggggtcccgggggggaaccttggggcccccccccgggc

SEQ ID NO: 34831 - protein, 158 aa, Zea mays
  misc_feature: Ceres CLONE 1413688-F
  misc_feature: SWISSPROT Homolog: EC 4.1.2.10 Mandelonitrile lyase
  misc_feature (107)..(107): Xaa is any aa, unknown, or other
  misc_feature (125)..(125): Xaa is any aa, unknown, or other
  misc_feature (126)..(126): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPTTTTHRDMARFATRCRTPPRLAAQXFVFEDGVINSPPAVAWRXXLESNAGFLNAGPREQITGGGGPGGEPWGPPPG

SEQ ID NO: 34832 - DNA, 958 bp, Zea mays
  misc_feature: Ceres CLONE 1413690-F
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (40)..(40): n is a, c, t, g, unknown, or other
  misc_feature (623)..(623): n is a, c, t, g, unknown, or other
  misc_feature (958)..(958): n is a, c, t, g, unknown, or other
nccccccccnnnnncccccccccccctccccccctccgcnccgccctttccaaagctggagctccaccgcggtggcggccgcctctacaactagtggatcccccgggactgcaggaattcgcacgagaccattacctagaacatcctaatcaaaaaccgaaccaaacaacacacgtcaaagcggaaaacctcagaaaaccacaataaatcatcctcgtccaccactgcccccgctctgctgcaactccactcggcgcggccgccctttccacccaccttgatcctctgatccgatggtgcttgaacagatacatgaacacccatatcggatcagtgaacgggccgggtgtcgaaccaaaccgcgctggcttgcccggcgctccgatccccggggtagcccgaagggtcggaacacgcccgggcgccactccccggcggcgaaccctggtcggaggaggtcaaggcgatccacttaaacgccgccaccctcccgccgcgatcgtcgcttaaagaaagtggtccgtgcgctcgagtttatgcttaattccacggcccctcctagggaagttaacttttttaccctctcaccgcacttgccatcgtacaccatcccggggacccgnccccctaaagcccacaggactaatatggatcgtctatccagaaccacactctcgccttaccactacccctaatcctcatacccgatacaatgaaattattatccctccacgtaatcatgcacaaaccaccttctacccggccgtgccccggcgttctccgcagaaccccctggcctccctttctcacaaccccctccccacaattcacctaagttttcccccatactaatgtactcgcaagccgtccccagaatgagagtgtattccccttaaccacgcaacaccaaccacttctgctgcacacccaactcgcgcggatccccaccccggggggn

SEQ ID NO: 34833 - DNA, 824 bp, Zea mays
  misc_feature: Ceres CLONE 1413691-R
  misc_feature (1)..(1): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
nttttttcacccccccatacccccacggggaacnngncttctcctttttttttccgattggggtccgggacccccctcaaggtcgacggtatcgatagtttttttatttattttttcaaaatgatgggtggttggtcggtgaaactaaggtttttcttggtactaaaatttctccaaaccacagcatcccaccctggaaaataaaacttttacaccgagtggaacctgtagaataatgtagtggctgaggtgatccacaaacgcgaggcaaaataatcatgaattacacaagcccgggcacagggctgcggcaaataacctatgaaatgacacccacagatttaagctcgcgggccctactctgatgaaaaacacaactctcccaacactatggggggaaaaagaaaatttgttgttgagagttctggttcattgatactcaaaatggttcggcggatgacggattgaggggtggccccccccccttttaaagtcataggtaaatgggtgaagctttccaagaacggttataaacaaaaataataaaccgggggtgggaccaatatttttaacactctagtcacggttgccccggcagctattgggctccggttaaaaccatggcatgaggtatacatcgctcccaaagaggtttttcagtcttattgctttgggtccacaaattgtttccacttaaggaaattgggctaccagtttctgggtgtaaaggatggtatcccctcatattgtcctaaagccccaatgttatctccacccacaccgcttgttagtctctcaaaacctgtattcttgtcacaccgccg

SEQ ID NO: 34834 - DNA, 678 bp, Zea mays
  misc_feature: Ceres CLONE 1413691-F
  misc_feature: Encodes the peptide sequence at SEQ ID NO. 34835
atagctggagctccccgcggtggcggccgctctagaactagtggatcccccgggctgcaggaattcgcacgagaccattacctagaacatcctaatcgaaaacttgcaagcaagcagctgctctcgtgtgacatctagtcgacgacagtcggtcacctctccagcctccaacaccaatcatcgaccaccgagctggcagctgtctgctcgcctcccccaactaggctaggactatgagccaccaaactctgccccgccatggcgggcctcgccgcctcaggcatactcggcccccggcggacgtgaccgtccccctggcgaatatctgctccgctgtgacgatcgcgcaacggcgtacagatcgaactccaccacaacgcacagaggctgagaggctcgtgaagcgtctcaaggagagtcatccgaagagggacggtctcgtctgtaccgcgagaaacacatgggtgatcgtgtgcatgcgcaacatggactacaagcgcgccagacgcttcgaggtcgacctctccgcgttgaggaacatcctcgagatcgacgcggagaggatggtcgccagggtggagtctctcgtcagcatggcccagataaccaaggctacctgccccatgaaactctcgctcgccgtggctcctgagttggacgaccttaccgtcggtggtc

SEQ ID NO: 34835 - protein, 148 aa, Zea mays
  misc_feature: Ceres CLONE 1413691-F
MSHQTLPRHGGPRRLRHTRPPADVTVPLANICSAVTIAQRRTDRTPPQRTEAERLVKRLKESHPKRDGLVCTARNTWVIVCMRNMDYKRARRFEVDLSALRNILEIDAERMVARVESLVSMAQITKATCPMKLSLAVAPELDDLTVGG

SEQ ID NO: 34836 - DNA, 673 bp, Zea mays
  misc_feature: Ceres CLONE 1413693-F
aagctggagctccccgcggtggcggccgctctagaactagtggatcccccgggctgcaggaattcgcacgagaccattacctagaacatcctaatcgaaaaaacagaaccttcgttccctgccgtctcttgtcggtctggccggccgaggtgggtgatctgtagagcgaaacgccgagccgggagaggagggaggccgcaccggcgattgtagaagcagaaccggtggaggagtagaggagggcgccgaatcgatgcgcggctccgcggacgccgtcgtggttgctcgggacgtggtggcctcgtcgagcccgtccaaggccgcgtcggcgttggacatgacgaggtacgcgaatccaccaccaatcccgttcgcctgccgctgcagctgcagctgcagcgttgtgttcgtcggtgttctttcctgagaccaaagccgcgaatttgcgctctcgtttccgcagtcagtggttgttgccggctcctgcggggctgattcgaacaagtttctccctttcgtgccgtgttcgcggcccttctctgctgttctcttcgcaagctcttcgaggcgccgtttgatctgcgggcaggccagttggtctcgcgtctcgcagcctgtgtctcaccgcccacctgtgctggttggtcttcgctggtctcggttcggttctcaa

SEQ ID NO: 34837 - DNA, 673 bp, Zea mays
  misc_feature: Ceres CLONE 1413701-F
  misc_feature (593)..(593): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaaaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctgccggtttcgtcgaccgctggtcaacctggccggtcggtcccggtggctcttcacctccgtgctgcctgccaccgtcgctttagtcaagtcttggccaagattttagctatctccggtcaaaaggctttaccgattcttggattggtggcttcttgggagcgagaagccggttcctgtttcgtctcttgtgctccagcatgttctgtagcacaccggttccccatctccagtgaaggtgttcgtgtgcttcttggtttttgtgcctcccggaaatcgtcccggaaagctacttttggccgcctgcggcgatggcgtcaagcacagcnnaagatggcccgaggggaaggagaaacctgaagaagtcccggtagctttgggagcaacgataccgtatgtgcgtgcatac

SEQ ID NO: 34838 - DNA, 676 bp, Zea mays
  misc_feature: Ceres CLONE 1413702-F
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaaccactagcaagtagcaacaggagcgcaggcagaactagagcggtcttggtatggcttcttccctcgcgcccgcgtcgtgggcactgccgctgcagatggtcggggctggggcggcagcggcggagccttcctgccgcgcgacgctagccgtcgtcacggagccccgctgggccgcgtcgctgcgccggtcaagggttctcgttggcgctggcgccccggtgcgtggcgctcgacgggcccggcgccagcggcgaggaggaggcgcccaagatcgaggacgagaggaataatagcggtgagacgaagaagccgtcgcgcggtcggccggtgtggagacggatcctcttcgcctccaagaagacacgatagtatcatcatcctcaacgccctcacggtcatctatgcaagggatattccggttttgaaagacgccgaagtcatgacagagcctgcgctctcaacatgttgcagttcgttgatgaagccatccgcttcgtaccattcgcgctccgatgcttcggagaccgcactgtacgctacgcgttactgnaggtggaacgctgcagtagctta

SEQ ID NO: 34839 - DNA, 736 bp, Zea mays
  misc_feature: Ceres CLONE 1413708-F
tggagctccccgcggtggcggccgctctagaactagtggatcccccgggctgcaggaattcgcacgagaccattacctagaacatcctaatcaaaaatagtttaatggttttctagtcgtccgtcctcctcggttctggctgccaaccccaagaactgccttgcctagtgcctactgcctagggaaggaccgaaggagaggtgcgcggctggtggcgtgcgagtggcagcggcgccgcgggactcttctcctcgccgctcgcctgctgggtgcgccatccctcgacggtgacaccgtgatattgctgtgaagttttgtggcacttcctgcatcccttatatgggtattaacaataattttaattggtctgggtgatccatttgagcaaatggaaggcaatgatgtaccccttggaaacatggttgcagggggtccccctatgaaagttttagactttacgtggcagctcctatgcaaaaattatgctccaaaactcagggaaacataatcttcagcaggctcccagatgccacgtactttcacaatggcctatgaccagggctacggagcctgatgactttcccggggggtttcagttcaagaaacagggaaaagagtggatgacccaccccccccacaccttagtctccctcaaaactgcaagaaggggtggtgggggaacttggtgtggggctgaaatgctactggaaccccaggggcaaaaggcaagaaggcc

SEQ ID NO: 34840 - DNA, 727 bp, Zea mays
  misc_feature: Ceres CLONE 1413709-F
  misc_feature: Encodes the peptide sequence at SEQ ID NO. 34841
  misc_feature (386)..(386): n is a, c, t, g, unknown, or other
  misc_feature (387)..(387): n is a, c, t, g, unknown, or other
atagctggagctccccgcggtggcggccgctctagaactagtggatcccccgggctgcaggaattcgcacgagaccattacctagaacatcctaatcgaaaagacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgataggggcgtcgcggctccacgccctggcctccagctccgccctcgaccaggatggatcnnccgcacgggggttgacctgctgcggcgctgcgatgacatggtcagcaagctcggcctcttctcccccaacgagaccaaaggaggacgtctccacagcaaacctcaagtacctactggtcccatattaccttgcagaaatgaccgaaaaatagcacagggagatcggatcccggttcttaagacgtcacagacattctgaaggagtcattgctctatgtgagtactagagcttatcccagagatggagctagaattgtctaggcagaaacagccagatactctgacaacaaaaaaacgcaaaaaggtgcccgggtcaaacggcaaaggctgcagaacaaag

SEQ ID NO: 34841 - protein, 120 aa, Zea mays
  misc_feature: Ceres CLONE 1413709-F
  misc_feature (55)..(55): Xaa is any aa, unknown, or other
MVDVEETGNKLQSQMRLHAEPEDDAADLPLPALFDRGVAAPRPGLQLRPRPGWIXRTGVDLLRRCDDMVSKLGLFSPNETKGGRLHSKPQVPTGPILPCRNDRKIAQGDRIPVLKTSQTF

SEQ ID NO: 34842 - DNA, 713 bp, Zea mays
  misc_feature: Ceres CLONE 1413712-F
ggagctccccgcggtggcggccgctctattaatagtggatcccccgggctgcaggaattcgcacgagaccattacctagaacatcctaatcgaaaatgacctagatctgtgcatgttttcttcgcatactcatggcgtccgccccacgagctacagcttgcacctcgccgggggacaaaagccgggaattatgttgcagggctggcgcctctcttgcagctcgcatctgcaaggaacgagaccagtaccgagacgcagctattctcctatcctaggccttctcgttcacagtagtggctacctctcgcgaccgtaattgattggcctgctgatgtcgtttccatcttcatctgcgtcttctggaccattgacgtggagggaggacgacaaactatctagccgctcgaacttgcagagctgatgagatcgactcaatcgcctgagactgaagttattctagtgatacattcagagctctggacgggatgacatcaagccagatggtttgtaatcccctccctctctgcaataattgctgcagggctaaccttgtccgctaagccaccttaaaggccgcccattgttggtttttttaagcagggggggattgggggaaaccttgttgttgaaaaggcccattcctttacccggagaaacccgggtaaaaaaactattataaaaaatttccagggttttctggcaaagaaaatgga

SEQ ID NO: 34843 - DNA, 733 bp, Zea mays
  misc_feature: Ceres CLONE 1413713-F
  misc_feature: Translation starting site: 198
  misc_feature (357)..(357): n is a, c, t, g, unknown, or other
  misc_feature (358)..(358): n is a, c, t, g, unknown, or other
  misc_feature (391)..(391): n is a, c, t, g, unknown, or other
  misc_feature (489)..(489): n is a, c, t, g, unknown, or other
  misc_feature (532)..(532): n is a, c, t, g, unknown, or other
  misc_feature (561)..(561): n is a, c, t, g, unknown, or other
aaagctggagctccccgcggtggcggccgctctagaactagtggatcccccgggctgcaggaattcgcacgagaccattacctagaacatcctaatcaaaaacaagaggtggccgccgcagtccgcaccccctccccaatcacgccacccgacaccgcgctccgcagattcgtagtcgccgctaggcttccggcgagatggacgtggtggaggcggcgcagttgtcggggcggacgctggaacgggtagtggtgcatcccttggtgctgctcagcatcgtcgaccactacaaccgcgtcgcccgcgacacccgcaaagcgcgtcgtcggcgtcctcctcggacctcatccccgcggnntccgtcgatgtcaccaactcctacgccgtgccngtttgaggaggatgacaagggatcctaggatctgggttccttgaccacaattaccacgagtcaatgttctccatgttcaagaggattaatgccaaggnagcatggttgttggctggtacagcactggcccaaaactaaggnagaccggacttggatgtccatgcattatncaacagttatgttcctaatccagtcttgggggattattgatgtccaccccaaggagctgggtataccgaccaagcgtactacggttggggaggaggttaaagagatgcactcaaaaagtcagaaggtatttgtcatgtccctcagaatgcagctcatgaagtgaggaaattg

SEQ ID NO: 34844 - DNA, 800 bp, Zea mays
  misc_feature: Ceres CLONE 1413717-F
  misc_feature (365)..(365): n is a, c, t, g, unknown, or other
  misc_feature (368)..(368): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (390)..(390): n is a, c, t, g, unknown, or other
  misc_feature (402)..(402): n is a, c, t, g, unknown, or other
  misc_feature (426)..(426): n is a, c, t, g, unknown, or other
  misc_feature (455)..(455): n is a, c, t, g, unknown, or other
  misc_feature (470)..(470): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacgaccacggcgcggtctcacccgtggagcgtgctangcnggnnncggcggctgtgctgctncctgtggttggncgtcgcagggttgctggagtgggnccctgggtgggcgcccccccggcgcgtgnaacccgtgcgcttgnagggncgcagggttcctgaagggggcaccccgggtacccgccttccctctggcggcgacccttcatcgagggaggcagccgtctcccgcgcgggcgttccctgggcaaggccccgtccccccgtgggtatcggccaacacgacttccggtcctcggcgtcgggccttttcctttcaccgcgtccttcaaagagcacgggaagttctccgtttacttggtttgggccccgaccccatgaagtttattccccgattccggactttgccccggaaagtgctggccaaataaagggggccaacttcctgaagccgctgttctcctccctgtcaa

SEQ ID NO: 34845 - DNA, 727 bp, Zea mays
  misc_feature: Ceres CLONE 1413721-F
  misc_feature: Encodes the peptide sequence at SEQ ID NO. 34846
  misc_feature (447)..(447): n is a, c, t, g, unknown, or other
  misc_feature (459)..(459): n is a, c, t, g, unknown, or other
ggagctccccgcggtggcggccgctctagaactagtggatcccccgggctgcaggaattcgcacgagaccattacctagaacatcctaatcgaaaaactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaaggagtcttcctcgtcgagaccatggacaacgcctcagctcccaggagtccatggcgcacctcaagggcgtctacttnctccgaacctcngctacaaacgtcagaagctccgcaggaacctcgcatgccgggcttcgccgagaccactattcttcccaaaatattgaggcccccgcaaatcaaaaactggttgctcggagagaacgggggtggcgcacaagtcacggagttcatggggattttggggcattgacccaacactttcccccccaaaaaaaaatacccgtgtgatgcccccccagggggcccccccccggaaagaggagttctgggacaaaccccttagaaattttttttg

SEQ ID NO: 34846 - protein, 129 aa, Zea mays
  misc_feature: Ceres CLONE 1413721-F
  misc_feature (72)..(72): Xaa is any aa, unknown, or other
  misc_feature (76)..(76): Xaa is any aa, unknown, or other
MVLITLVRDYIDRMLHDIPGMKVLVLDPQTVGMVSVVYSQSDLLRKGVFLVETMDNASAPRSPWRTSRASTXSEPXLQTSEAPQEPRMPGFAETTILPKILRPPQIKNWLLGENGGGAQVTEFMGILGH

SEQ ID NO: 34847 - DNA, 721 bp, Zea mays
  misc_feature: Ceres CLONE 1413723-F
  misc_feature: SWISSPROT Homolog: EC 2.7.11.1 Non-specific serine/threonine protein kinase
  misc_feature (558)..(558): n is a, c, t, g, unknown, or other
  misc_feature (563)..(563): n is a, c, t, g, unknown, or other
  misc_feature (564)..(564): n is a, c, t, g, unknown, or other
  misc_feature (670)..(670): n is a, c, t, g, unknown, or other
  misc_feature (714)..(714): n is a, c, t, g, unknown, or other
aaagtggagctccccgcggtggcggccgctctagaactagtggatcccccgggctgcaggaattcgcacgagaccattacctagaacatcctaatcgaaaaagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaaagaaagctccgagttcttcagttctggatcgatagagaggcggttcctttgcgggctctgaggttcagctctcgctcttgatttgtctcatcgacgcatcagttgggctgcaggcttagagctggaaggaataatttgactagagaaaatggggcagtgttgtagcagagctcccgccccggactctgggacggggaggcaccaaatggttatggctattctaaccaggcaaagccagcgcaaacaccttcgagttacaaccctcctcagagncgggnncgaggtgagtaacacgccgccggcgacgaaaccctccggtagtccaacctgtgccctggtgctgtgccaccgaaggccacggcggacacaatcttggaaaaaaggnacgaggacgtacgctctgtcactccctcgggaaaggagctgggnccgggcc

SEQ ID NO: 34848 - DNA, 747 bp, Zea mays
  misc_feature: Ceres CLONE 1413729-F
  misc_feature (16)..(16): n is a, c, t, g, unknown, or other
  misc_feature (238)..(238): n is a, c, t, g, unknown, or other
  misc_feature (241)..(241): n is a, c, t, g, unknown, or other
  misc_feature (244)..(244): n is a, c, t, g, unknown, or other
  misc_feature (304)..(304): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (597)..(597): n is a, c, t, g, unknown, or other
  misc_feature (723)..(723): n is a, c, t, g, unknown, or other
tccccgcggtgggggncgctctagtactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagnggntangcccaaaccaaaaaaaaaccttgtttggggaaaaaaaaattttttcccccacggcggggntttggggggnnnccggccccctcttctcaaaaaaaaaaaaaaaaaaaaaagggggggggggggaatcccccccccccccccccccgggggtttttttttttttttgggaaaaaaaaaaaaaattttttttttttccccaaaaaaaaaaaaaggggggggggggggggggggggtttttttttttttccccccccccccccccacattgggtgtggttgtgtgtgttgtttttctgtgggggaaaaaaaaaaaaaaaaaaaaaaaaaagggtggtttttgttttttgttggttntatttgtaaaaaaaaaaaaaaacaaacaaacctctttctttcgtgtttgtttgtttttttgggggggaggaggggggaggaggaagaaacaaaaaaacaaaagaaaaaaaaagaaaaaaaaagagnaaaaaaaaaaaaaaaaaaagaaac

SEQ ID NO: 34849 - DNA, 701 bp, Zea mays
  misc_feature: Ceres CLONE 1413731-F
  misc_feature: Encodes the peptide sequence at SEQ ID NO. 34850
  misc_feature (472)..(472): n is a, c, t, g, unknown, or other
  misc_feature (478)..(478): n is a, c, t, g, unknown, or other
  misc_feature (551)..(551): n is a, c, t, g, unknown, or other
  misc_feature (593)..(593): n is a, c, t, g, unknown, or other
  misc_feature (606)..(606): n is a, c, t, g, unknown, or other
  misc_feature (632)..(632): n is a, c, t, g, unknown, or other
  misc_feature (684)..(684): n is a, c, t, g, unknown, or other
  misc_feature (685)..(685): n is a, c, t, g, unknown, or other
  misc_feature (691)..(691): n is a, c, t, g, unknown, or other
tggagctccccgcggtggcggccgctctagaactagtggatcccccgggctgcaggaattcgcacgagaccattacctagaacatcctaatcgaaaactggagctttcttggtcaacaaacagcgcacttgaacttgtcctccttgtcctcctcgaaaacaccagccggcggccgactcgactcgactacttcaattcgtcgtagtgtgctccaagaaccaacagcacgctctccctctccccgacggctgctagctagcgacaacagatcgacggcaacaccgatgggcgaggccaacgccacaggcacgccagccaccgcgacggtgcgcgtgctggccgtgtcgcgcgtcgcgccggcgccggcgccggcagcggcggaccccgtcgtcgtcaagctgtccttcttcgacacgccctgggtcgtgctgccgcccatccagcgggtgttcctgtacgagctgcctggtgncgacgntgagttcacggcggcagtgacgcgcctcaagagctccctcgccgccacggctggcggtgtacctggccgctgnccgggaagctggcgtacgccccgccacccgggggaacggggnccggggactgccncgacccacccccgggggggcctcccnccaagccggaagcgaacccccgaaacgaaccccagggaccccccccgggtgnnaacggncaaggccccc

SEQ ID NO: 34850 - protein, 139 aa, Zea mays
  misc_feature: Ceres CLONE 1413731-F
  misc_feature (63)..(63): Xaa is any aa, unknown, or other
  misc_feature (65)..(65): Xaa is any aa, unknown, or other
  misc_feature (89)..(89): Xaa is any aa, unknown, or other
  misc_feature (108)..(108): Xaa is any aa, unknown, or other
  misc_feature (134)..(134): Xaa is any aa, unknown, or other
  misc_feature (136)..(136): Xaa is any aa, unknown, or other
MGEANATGTPATATVRVLAVSRVAPAPAPAAADPVVVKLSFFDTPWVVLPPIQRVFLYELPGXDXEFTAAVTRLKSSLAATAGGVPGRXPGSWRTPRHPGERGPGTAXTHPRGGLPPSRKRTPETNPRDPPRVXTXKAP

SEQ ID NO: 34851 - DNA, 736 bp, Zea mays
  misc_feature: Ceres CLONE 1413733-F
  misc_feature: Encodes the peptide sequence at SEQ ID NO. 34852
  misc_feature (308)..(308): n is a, c, t, g, unknown, or other
  misc_feature (323)..(323): n is a, c, t, g, unknown, or other
  misc_feature (324)..(324): n is a, c, t, g, unknown, or other
  misc_feature (327)..(327): n is a, c, t, g, unknown, or other
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaagccttgaccgacgtgactacggtacggcccccaaacccggaacggcagcgaaacgacagccatgcttctccagccgatccccaccgccaccctcgccgctcgaccgagatcaagcgaagcttccttcccctttcgttgccaccgccgccgccgcgtgctcctcccagtccgcgccgacttgaccccgatctccctctcggctcggnccccccttcgcgggnnggnaaagccggccgtttgcaccgccgacgagctccactacgcctccgtcgacggtgccgggtggcgactcgcgctctggcggtacaggccaccgcgcaatgctcccgtcaggaatcacccgctgatgctgctgntcggagtcgggacgaacgccgtcggattcgacctctcacccggggcttcgtttgcccgtcacatgtctagccaaggatttgatacatggaatagtgaagaaagaggtgctggtctgagcatgcgtgaatatgatgattctactccatctggctcagccacttttgaggatgtctctaggggaattcaacctcctaaaagtacattcggggccacttccattcagaggtctgggggctatgctaggggattgggagacccttgaaatagtggttttgaa

SEQ ID NO: 34852 - protein, 185 aa, Zea mays
  misc_feature: Ceres CLONE 1413733-F
  misc_feature (49)..(49): Xaa is any aa, unknown, or other
  misc_feature (54)..(54): Xaa is any aa, unknown, or other
  misc_feature (55)..(55): Xaa is any aa, unknown, or other
  misc_feature (99)..(99): Xaa is any aa, unknown, or other
MLLQPIPTATLAARPRSSEASFPFRCHRRRRVLLPVRADLTPISLSARXPLRGXXKPAVCTADELHYASVDGAGWRLALWRYRPPRNAPVRNHPLMLLXGVGTNAVGFDLSPGASFARHMSSQGFDTWNSEERGAGLSMREYDDSTPSGSATFEDVSRGIQPPKSTFGATSIQRSGGYARGLGDP

SEQ ID NO: 34853 - DNA, 746 bp, Zea mays
  misc_feature: Ceres CLONE 1413734-F
  misc_feature: Encodes the peptide sequence at SEQ ID NO. 34854
  misc_feature (401)..(401): n is a, c, t, g, unknown, or other
  misc_feature (431)..(431): n is a, c, t, g, unknown, or other
  misc_feature (526)..(526): n is a, c, t, g, unknown, or other
  misc_feature (535)..(535): n is a, c, t, g, unknown, or other
  misc_feature (542)..(542): n is a, c, t, g, unknown, or other
  misc_feature (595)..(595): n is a, c, t, g, unknown, or other
  misc_feature (596)..(596): n is a, c, t, g, unknown, or other
  misc_feature (607)..(607): n is a, c, t, g, unknown, or other
  misc_feature (664)..(664): n is a, c, t, g, unknown, or other
aaaagctggagctccccgcggtggcggccgctctagaactagtggatcccccgggctgcaggaattcgcacgagaccattacctagaacatcctaatcgaaaacttttattcctccttggcaaggccatgccaccgtcgagcccaggaggcggaagtcaacgtaaccaagcgaacccatccatggcctccgctgctgccgtcgtctccctcaacgtcggcggcgagatcttccagaccaccaccgccacactttcccgcgccggcgcctcctccccgcttgcctccctcggtccctcctccccgtctgctccgcacttcctcgacggcgacccgcgcctctttgcccaactcctatccttcctccgccatggccgcctccttgctccgtcctatccctcangccacgctcctcgctgaggcgcgccacttncgcgctcgatggcgccctcctcgcttctctctccccggcctccgcctttgccccgctctcgctgcgcccttccgcgctcctcccgctcaccgggncgcgtcggnccctcgncccgtagcgctgtgcccctcgccgcctcacccggtctcctcgcgcgaaaaaannggggggggggncgtcacctggtttcgaacgcgcgctcggctccccccacagcgtcttcagccgctgtncccgcgtgttttttttttttttggccgggggggtcccccggtcttcgcccctcgccgggggccgggaaccttccacggggct

SEQ ID NO: 34854 - protein, 96 aa, Zea mays
  misc_feature: Ceres CLONE 1413734-F
  misc_feature (92)..(92): Xaa is any aa, unknown, or other
MPPSSPGGGSQRNQANPSMASAAAVVSLNVGGEIFQTTTATLSRAGASSPLASLGPSSPSAPHFLDGDPRLFAQLLSFLRHGRLLAPSYPSXHAPR

SEQ ID NO: 34855 - DNA, 733 bp, Zea mays
  misc_feature: Ceres CLONE 1413737-F
  misc_feature: Translation starting site: 225
  misc_feature (323)..(323): n is a, c, t, g, unknown, or other
  misc_feature (548)..(548): n is a, c, t, g, unknown, or other
  misc_feature (675)..(675): n is a, c, t, g, unknown, or other
caaagctggagctccccgcggtggcggccgctctagaactagtggatcccccgggctgcaggaattcgcacgagaccattacctagaacatcctaatcgaaaagacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctncttcgataggggcgtcgcggctccacgccctggcctccagctccgccctcgaccaggatgggatccccgcacgggggttgacctgctgcggcgctgcgatgacatggtcagcaagctcggcctcttctcccccaacgagaccaaaggaggacgtctccacagcaaacctcaagtacctactggtcccatattaccttgcagaaatgaccgaaaaatagcacaggnaggatcggatcccggttcttaagacgtcacaggacaatctgaaggagtcattgctctatgtgaagtactagagcttatcccagaggatgagctagaattgtctaggcagaagcagccagatactctngacaaaaaaaagcgcaaaagggtgccccggtcaaacgtcaaaaggctgcagaacaaac

SEQ ID NO: 34856 - DNA, 861 bp, Zea mays
  misc_feature: Ceres CLONE 1413739-F
  misc_feature: Encodes the peptide sequence at SEQ ID NO. 34857
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
cttccttctctccccccgccntacgcggggggggggnnnnttcataactggactccccgcggtggcggccgctctataactagtggatcccccgggctgcgggagttcgcacgagaccattacctagaacatcctaatcgaaaaatgcgctccccgccttccgcttccctaccccccgcatcacctaccaacgccgacaccatgggggccttcgcgaaggaggagcaccagttcctagccgagctcggactcgcgcagagcaacccaggcgcgttcgcatgcggtgcgtggggcggctcaggtcccaccgtcccgtcgacgagcccgaccaacaatcaggtcatcgcagaggtcgaggaggcgtccgtgcacgactacgaggagggcatgcgcgcctgcttcgacgccgccaaggcatgcgatgccgactgccgctccaaagggaggagagatcggttaccccaaatccggtgaggcactgaaaagcaaagctcccatcacccttgccaggccttgggggcagttggagatggggaaaaattctttcctggaaaggcccgggtgaagtctccaggaaatccatcggagcgtggggacacttactggctggggcccctttcggcccggccccgtgtaaatgggctccctttattccccttcttgaacggcccaaatccacaatgcatgaatgcgcggtggggggaaaccccccctaggcagtagggcggcttgtttacaaaccggcattctcacacctcccctcggctgctggcgcttccgccgcgaataggccgggcctcttgcatctgggacacgaaccgcaaaagggctcgcgaacccggactaagggggcgcccacca

SEQ ID NO: 34857 - protein, 90 aa, Zea mays
  misc_feature: Ceres CLONE 1413739-F
  misc_feature: SWISSPROT Homolog: EC 1.2.1.3 Aldehyde dehydrogenase (NAD(+))
MGAFAKEEHQFLAELGLAQSNPGAFACGAWGGSGPTVPSTSPTNNQVIAEVEEASVHDYEEGMRACFDAAKACDADCRSKGRRDRLPQIR

SEQ ID NO: 34858 - DNA, 713 bp, Zea mays
  misc_feature: Ceres CLONE 1413740-F
  misc_feature: Encodes the peptide sequence at SEQ ID NO. 34859
  misc_feature (522)..(522): n is a, c, t, g, unknown, or other
  misc_feature (540)..(540): n is a, c, t, g, unknown, or other
  misc_feature (579)..(579): n is a, c, t, g, unknown, or other
caaagctggagctccccgcggtggcggccgctctagaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtgggcgcttcttcttcgggatctcgctggaccgagcggcccagggctagggattcaggcccatggcgtggcggcgcgtcctcacccagattgcaaggcatcgaccagcaaaagcaatctacaatgaactagttgcttcctcccctttgggtgttcttcgaagtgacatcacttcaggtgcccagattagacatttacaagagaggaacccagtcagttacattgntagccttgcacgccgggntccgagacttagaatcacccagcggaacttctctgcttnaagagatttacagaagtgacccagaggcgtgtcatacaattatttgaaagccaaccttcattacattcttattcctgcaagaattttcggagtatgtaaaaagctcttggaagggtttaataaggttgaatgaa

SEQ ID NO: 34859 - protein, 79 aa, Zea mays
  misc_feature: Ceres CLONE 1413740-F
  misc_feature (55)..(55): Xaa is any aa, unknown, or other
  misc_feature (61)..(61): Xaa is any aa, unknown, or other
  misc_feature (74)..(74): Xaa is any aa, unknown, or other
MAWRRVLTQIARHRPAKAIYNELVASSPLGVLRSDITSGAQIRHLQERNPVSYIXSLARRXPRLRITQRNFSAXRDLQK

SEQ ID NO: 34860 - DNA, 768 bp, Zea mays
  misc_feature: Ceres CLONE 1413743-F
  misc_feature: Encodes the peptide sequence at SEQ ID NO. 34861
ccatgctggagctcaccgcggtggcggccgctctagaactagtggatcccccgggctgcaggaattcgcacgagaccattacctagaacatcctaatcgaaaaaaaaatctagccaaaaaagcccaaccaaaatgctgcctgcccgccccctcctcgtggccgccgccgtcttcctcctcctcctccccgttcacgtcgccatcgtcgccgcacaggggtttcgcggcttctcttacctcctaaactgtggcgcggcgtcccccaccaccgacagccgcggcctccgctgggatcccgatggcgactatgtctctgccggtacccccggcgtggtctcgctctcgggcctcatcaaccccacgcttgccacccttcgcaccttcccgctccgctacggggccaagttctgctacgagctccccgtggatcggaaccgccgctacctcatccgccccacattcttctacggcgcgctcttcgcctcctcctctgcaccgccgccgcccgtcttcgacctgatcgtggacgggaccttctggaccgccgtcaacaccaccgatgacgcgctggccggcgccgcgtcgtctaacaaggcgtgttccctgcgagtggcaggacatgaacttctgccccgggagagaacccgactataccgacgccaggccattcatttcccgcgctgcaagtggatccagctcgaacaattcccaggacaaaggcaactgattttcccaacaaaggcgattgggcctcattgattcgaacca

SEQ ID NO: 34861 - protein, 208 aa, Zea mays
  misc_feature: Ceres CLONE 1413743-F
MLPARPLLVAAAVFLLLLPVHVAIVAAQGFRGFSYLLNCGAASPTTDSRGLRWDPDGDYVSAGTPGVVSLSGLINPTLATLRTFPLRYGAKFCYELPVDRNRRYLIRPTFFYGALFASSSAPPPPVFDLIVDGTFWTAVNTTDDALAGAASSNKACSLRVAGHELLPRERTRLYRRQAIHFPRCKWIQLEQFPGQRQLIFPTKAIGPH

SEQ ID NO: 34862 - DNA, 760 bp, Zea mays
  misc_feature: Ceres CLONE 1413744-F
  misc_feature: Encodes the peptide sequence at SEQ ID NO. 34863
  misc_feature (465)..(465): n is a, c, t, g, unknown, or other
aaagctggagctccccgcggtggcggccgctctagaactagtggatcccccgggctgcaggaattcgcacgagaccattacctagaacatcctaaaaaaaaaaccgctatggtccatccacatccacagtcgccatcgcccccacctctcaccgtcgtcttcgtgcaccactcggcctccactgccggtcgcgcctcccagccacctcgtgccgctctgccaccccgcgcatcctccaccgcccctatggctgccacgggcgagcgctgcccgagcagtcgaccgccctttccgtgccgccccgcctccccgctaggcctccactgcccactgctccggcgcctacagtggaaggcaaggagaaggacatcgggcggcggtagctggatctggcaagcacaaggccgcgcccccggcggcgcctggatctgcgttgcttgcaccccccccccccccacccccccnaaacacaaacacacacaacagattttgctacagggacaatcctgatcggtcggcgcatccgcctagaggcccggggagtgacgaaaaaacgcctcctcagcccttatcctcaagtcgtccccaccgaaaaaccgcccaacggccccctgacccaacaaggacaattattttattggcagcaccgatggggggggggaaaaacgtggaagcttgctttccaaaacgggtattcaagaaaaaaatcgacatttgcccggtggcaaagagacggcaatgaacttgtaacctcaaggcg

SEQ ID NO: 34863 - protein, 30 aa, Zea mays
  misc_feature: Ceres CLONE 1413744-F
MGGGKNVEACFPKRVFKKKIDICPVAKRRQ

SEQ ID NO: 34864 - DNA, 738 bp, Zea mays
  misc_feature: Ceres CLONE 1413748-F
  misc_feature (538)..(538): n is a, c, t, g, unknown, or other
aaagctggagctccccgcggtggcggccgctctagaactagtggatcccccgggctgcaggaattcgcacgagaccattacctagaacatcctaatcgaaaaagtcagttcctcctactcccgatccatttgcagagggcagcagccacctcctctccccgcggccgagctcgcgcctcgcccgccgcctgaactcgtcttgcctgcggccgatctcccccctccgttcttcgccgcaacccggagaggagaccgcgctcggtcgagcaccccctggggcagcgtcctcgcgaccagctccggcgcggcgtccgccctcagcagcccgggtgtccccgggaacgtctccggctcggccggcacacagctcgacaggcttttcagttcagtgcagtgtaccaagattctctgttaatttgtgtatgagatcagttaactgataaagacatgtgaagaaccagtgatcagtaatctgtacgcttcagattgtagtatccttgagatggatggaagagatcaggcttatggtaaatctggntgaatatcatggggagtcagcaaagtctggcctgactaagactagtaaaaatacggtgcttcatctcagatcatcattgggtgagaatgaggtccccaaaccgttatataatagaatgggtgaccatcatctgcccaatggtttgctaccttgagcgggggggtttcccaaattacaatacggttgcagctgatgccctc

SEQ ID NO: 34865 - DNA, 773 bp, Zea mays
  misc_feature: Ceres CLONE 1413750-F
  misc_feature: Encodes the peptide sequence at SEQ ID NO. 34866
  misc_feature (308)..(308): n is a, c, t, g, unknown, or other
  misc_feature (433)..(433): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaaaacgatggacgccagcccatgggccaacgatcctccgtggaccgacttcctaaccgcacgaacctccgagacggagcgtggcgcccgcctcggcgcctccgccctccgtcggcggcgcacggggagcatagaaggtgtcgtactcgtacctctcgcacacgcccccatcgccacgcgtgcaacgaagctggctccgtcgccatggncctgctgccgttgcccccctgctccccgctgccaccgccgggccgcggcctttggcggggcccccgggccgcctcccgggcggcaccggcaggggaagcctgcgcctccccttgtaagccggtgntgcccgcttcccgcaacannnnnnnnnnctcacccccccggggggaaaaccccgttccccgccccgcnaaaaggggggagggggaagggttttaacccccctcgcggggttattcctttccgcggagggtttcggtggggaaaaaaccttttttcgaagagaggaaaaaggtttaaaaaaaggggaaaaacccctcccaaccctgttttggttttgaaaaaacccccgggtttaaaatttggggaaccgaaaaaaggggggaaatcctcctttttccaaagggaaaggtccccttttccggggtcatcgatataactccccggcgggggagagggagaac

SEQ ID NO: 34866 - protein, 135 aa, Zea mays
  misc_feature: Ceres CLONE 1413750-F
  misc_feature (63)..(63): Xaa is any aa, unknown, or other
  misc_feature (105)..(105): Xaa is any aa, unknown, or other
  misc_feature (111)..(111): Xaa is any aa, unknown, or other
  misc_feature (112)..(112): Xaa is any aa, unknown, or other
  misc_feature (113)..(113): Xaa is any aa, unknown, or other
  misc_feature (114)..(114): Xaa is any aa, unknown, or other
MGQRSSVDRLPNRTNLRDGAWRPPRRLRPPSAAHGEHRRCRTRTSRTRPHRHACNEAGSVAMXLLPLPPCSPLPPPGRGLWRGPRAASRAAPAGEACASPCKPVXPASRNXXXXSPPRGENPVPRPAKRGEGEGF

SEQ ID NO: 34867 - DNA, 758 bp, Zea mays
  misc_feature: Ceres CLONE 1413751-F
  misc_feature: Encodes the peptide sequence at SEQ ID NO. 34868
  misc_feature (571)..(571): n is a, c, t, g, unknown, or other
  misc_feature (670)..(670): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaatatgtttattaaaaataaaaatgtccgctgcttgcttcgtcccgttctggcgttcacacctctggctgccttcatttcctgttgacgactgagcgggcgagcgccggcgccctttgccaggtccgtcggcccgttagccggcgactagcgcctccctttgccaggtcttcgacgtccccttcgccgtcgactggcgcccagcagccagcagcagatccttttctatctgtcgtgttctgtctgcctggtacatttggaagaatgggggtttaccttagcactccgaaaactgagaaggtatccgaagatggggaaaatgataaacttaaattcggagtttcatctatgcaagggtggcgtacaactatggaagatgctcactcggctttgctagatctcgacaatgacactgcgttttttggtgtttttgatggacatggaggaaaagtagtcgccaaattctgtgcnaaatatctacacagagaagttctcaggagtgaagcctatgcagctggtgacctgggtgctgctgtcacagagcttacttcagaatggatgaaatgatgncgagtcaaagaggatggncggaacttcaagcacttggagataaaataaatcagtttagtggcataatagaaggcttaattttgtctcc

SEQ ID NO: 34868 - protein, 100 aa, Zea mays
  misc_feature: Ceres CLONE 1413751-F
  misc_feature: SWISSPROT Homolog: EC 3.1.3.16 Phosphoprotein phosphatase
MGVYLSTPKTEKVSEDGENDKLKFGVSSMQGWRTTMEDAHSALLDLDNDTAFFGVFDGHGGKVVAKFCAKYLHREVLRSEAYAAGDLGAAVTELTSEWMK

SEQ ID NO: 34869 - DNA, 754 bp, Zea mays
  misc_feature: Ceres CLONE 1413753-F
  misc_feature: Encodes the peptide sequence at SEQ ID NO. 34870
  misc_feature (415)..(415): n is a, c, t, g, unknown, or other
  misc_feature (435)..(435): n is a, c, t, g, unknown, or other
  misc_feature (458)..(458): n is a, c, t, g, unknown, or other
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaaaaaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacaatgtggtcgtcaatgtgctcaacagcttagacgagcccctgctcatcacttgggatgggatccagcagcgcaagaattgcntggcagatgggggtctcggnaccacctgccccataccgccagnttggaactggacctacaacttccaggtcaaggaaccgattggnaggttcttctactttccaccccttggtatgcacgtggcgcggggggggtcggaaggatccctggcaaaaaaccgggggggtatttccgggcccttcgaaccgcccgagggggaactccacgctcttatcggggactgggacaaaaagaaccccccccccctggaaaaaatgtccccccccccaaaaaacatggggaatcccaaacgtgttttttataaaggggcaggggccaaataaggaaaaagccccccct

SEQ ID NO: 34870 - protein, 198 aa, Zea mays
  misc_feature: Ceres CLONE 1413753-F
  misc_feature (31)..(147): Pfam Name: Cu-oxidase_3 Pfam Description: Multicopper oxidase
  misc_feature: SWISSPROT Homolog: EC 1.10.3.3 L-ascorbate oxidase
  misc_feature (92)..(92): Xaa is any aa, unknown, or other
  misc_feature (106)..(106): Xaa is any aa, unknown, or other
MGPPFLAVAVIVAFLAAAAQAADPFAFFDWDVSYITASPLGVPQQVIAVNKQFPGPIMNVTTNYNVVVNVLNSLDEPLLITWDGIQQRKNCXADGGLGTTCPIPPXWNWTYNFQVKEPIGRFFYFPPLGMHVARGGSEGSLAKNRGGISGPFEPPEGELHALIGDWDKKNPPPLEKMSPPPKNMGNPKRVFYKGAGAK

SEQ ID NO: 34871 - DNA, 747 bp, Zea mays
  misc_feature: Ceres CLONE 1413756-F
  misc_feature: Translation starting site: 214
  misc_feature (583)..(583): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (642)..(642): n is a, c, t, g, unknown, or other
  misc_feature (644)..(644): n is a, c, t, g, unknown, or other
  misc_feature (646)..(646): n is a, c, t, g, unknown, or other
  misc_feature (647)..(647): n is a, c, t, g, unknown, or other
  misc_feature (649)..(649): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (680)..(680): n is a, c, t, g, unknown, or other
  misc_feature (683)..(683): n is a, c, t, g, unknown, or other
  misc_feature (684)..(684): n is a, c, t, g, unknown, or other
  misc_feature (697)..(697): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (724)..(724): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (745)..(745): n is a, c, t, g, unknown, or other
aagctggagctccccgcggtggcggccgctctagaactagtggatcccccgggctgcaggaattcgcacgagaccattacctagaacatcctaatcgaaaaagatcgttccgtaagggcacccatcgtcatagatacgattcatagcttctgccactacttgtgcgcgaagagccaagaaatgcgtcaggggttgtgaagggaaggagtgccgatggccggtggccacccggcgccgctgcggccggtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggatgctcaacgacctctcctacgccgtgctgtggcggatggctgagcgccaggtaaggctcggactgtctgtcgtcatcgattcaccgctgtcacgccgctctcacctcgacatgctgacacgcctagccggtgtgcttgtggtcgtcgtggagtgtcgccctggtgataacgaggaatggcgcccggagctgnagagccgtggtcgtgtccaacaggggggggggcggnnnnnnnnnnnnnnnnnncnnnancntnntnttttnnnnnatnnnnntgntnnannnnattnaannattttttccattnattattttttcnnncnncncccccccncccccccccnnnncttccccnct

SEQ ID NO: 34872 - DNA, 732 bp, Zea mays
  misc_feature: Ceres CLONE 1413758-F
  misc_feature: Encodes the peptide sequence at SEQ ID NO. 34873
  misc_feature (647)..(647): n is a, c, t, g, unknown, or other
aaagctggagctcaccgcggtggcggccgctctagaactagtggatcccccgggctgcaggaattcgcacgagaccattacctagaacatcctaatcgaaaaaagaagaacatcgccattgcagcaagtctgtatgatctgtgacagctgtcgatagaattatcacacacattcgttattcgttgaactaaaaccatggcgaggccgtccgaccaaagcggcgtccacgtcctcctgctcccattccccacgcagggccacatcaacccgctgctccagttcggcaagcggctcgccggccgcgctggcgtccggtgcacgctcgcggcgacccgcttcgtcgtcagctcgacgaagccgaccccgagctcggtccacgtcgccgcgatctccgacggctgcgacgagggcggccccgccgaggtggcaagcatgggcgcccgctacttcgagcgcctcaaggcggccggcccccaaacgctgaacaaggccctccctccaaagccccccctgcggcgaacgatgcacgtgctggtgtacgacccctttccacccctggccccaccgcgtggcgtcgcagccccgcctcccccagccgcgccttcctcccccaaacttgcgccgtgtgaatctgggacctccccccnctggccccgccctcctcccgttcccccccctgccgtttaaccaccagaagcccgagttccctcctttttgtttggccgtcccact

SEQ ID NO: 34873 - protein, 163 aa, Zea mays
  misc_feature: Ceres CLONE 1413758-F
  misc_feature (11)..(118): SWISSPROT Homolog: EC 2.4.1.121 Indole-3-acetate beta-glucosyltransferase
  misc_feature (5)..(36): SWISSPROT Homolog: EC 2.4.2.40 Zeatin O-beta-D-xylosyltransferase
  misc_feature (151)..(151): Xaa is any aa, unknown, or other
MARPSDQSGVHVLLLPFPTQGHINPLLQFGKRLAGRAGVRCTLAATRFVVSSTKPTPSSVHVAAISDGCDEGGPAEVASMGARYFERLKAAGPQTLNKALPPKPPLRRTMHVLVYDPFPPLAPPRGVAAPPPPAAPSSPKLAPCESGTSPXWPRPPPVPPPAV

SEQ ID NO: 34874 - DNA, 609 bp, Zea mays
  misc_feature: Ceres CLONE 1413760-F
  misc_feature (220)..(220): n is a, c, t, g, unknown, or other
  misc_feature (261)..(261): n is a, c, t, g, unknown, or other
  misc_feature (285)..(285): n is a, c, t, g, unknown, or other
  misc_feature (287)..(287): n is a, c, t, g, unknown, or other
  misc_feature (289)..(289): n is a, c, t, g, unknown, or other
  misc_feature (290)..(290): n is a, c, t, g, unknown, or other
  misc_feature (301)..(301): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (508)..(508): n is a, c, t, g, unknown, or other
  misc_feature (516)..(516): n is a, c, t, g, unknown, or other
  misc_feature (540)..(540): n is a, c, t, g, unknown, or other
  misc_feature (571)..(571): n is a, c, t, g, unknown, or other
  misc_feature (573)..(573): n is a, c, t, g, unknown, or other
  misc_feature (586)..(586): n is a, c, t, g, unknown, or other
aaagctggagctccccgcggtggcggccgctctagaactagtggatcccccgggctgcaggaattcgcacgagaccattacctagaacatcctaatcgaaaaaaacgaaagatcctcctccctcccaaaggtgaggccgttagccaggaattccggcaacaatgacttccctctcctccgcggtggcactgccgtcctcgtgccgggcccggccggcggngggcagccggagggcgcggatggtggtgaacgcgcgcgcgncgtcaagcccgaagctgccgaacngncnncgcgctgcggntgcctggtgtgggaaggcggccccgccggtggcccccccggcggaaggccttggccaaagggcggggggggaaaaaaggtgttttaatcccccggggaaaaagggaaaaattggaaacccccctggggggggccccccccccccggtgggaggaggggggggggaaaaccaacccctcccgccccccacccctctgnnnnnnnnccncccccccnccgggcgggggggggagaaaaaanaaagaaaacaaattttttttttttttttttntncccccccgccccncccccccccccacccccccccct

SEQ ID NO: 34875 - DNA, 2196 bp, Zea mays
  misc_feature: Ceres CLONE 1413762
  misc_feature: Encodes the peptide sequence at SEQ ID NO. 34876
gaaacacagcagacaggagcaacattcacggacggaaacccctcaaccccgaccccctcgaggcctcgacccgacccgacccgcctccaactccaagccaagccaccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgtcgactgctcctacggcctctcccccgaggacctccgtgccaagatctcgctctgcgacgcgctcatcgtcaggtccgggaccaaggtcggccgcgacgtcttcgaggcgtccgggggcaggctccgcgtcgtcggccgcgccggcgtcggcatcgacaacgtcgaccttgccgccgccaccgagcacggatgcctcgtcgtcaacgcgcccactgccaacaccgtcgccgccgccgagcatggcatcgcgctgctcaccgccatggcctggaacatcgcgcaggcggacgcgtcactcaaggctggtaaatggcagcgcaacaagtatgttggtgtatctcttgtgggcaaaactctcgcgattcttgggttcgggaaggttggttcagaagttgctcgtcgcgctaaaggtttaggaatgcatgtgattgcacatgatccatacgcttctgctgatcgggcccgtgcaattggagttgagctagttagtatggaggaggccatgacaactgctgacttcatctcattgcacatgcctcttacccctgcaacaaacaagatgctcaacgatgaggcctttgctaagatgaagtatggtgttcgcattataaatgttgcacgcggtggtgtgattgatgaagatgctctagtcagggctcttgattcaggaatagtagcacaggctgctcttgatgtgttcactaaagaacctccagctcctgataacaagttggtgctgcacgtgaatgttactgtcacacctcaccttggtgccagcacagtggaggcacaggaaggagtggctattgagatagctgaagctgtcattggagctctgaaaggggaacttgcagcttctgcagtcaacgctccaatggttcctgctgaggtgctgtcagagcttgcaccttttgttgtgcttgcagaaaagcttgggcatttagctgtgcaactagttgctggtggtggtggcatcaagtctgtgaaagtgacctatgcatctgcacgggcccctgatgatcttgacacgagacttctccgtgcaatgatcaccaagggattgattgagccaatctccagcgtttttgtcaatcttgttaatgctgacttcaccgcaaagcagaggggagttcgcatcactgaggagaggatcatcttggacggctcacctgagacgcctatcgactacattcaagttcagattgccaatgtcaagtccaaatttcctagtgcgatatctgagactggagagatcacagtggaggggagagtgaaggatggcgttcctcatctaacaaaggttggagcattccaggtggatgtgagcttggaaggaagcctgatcctttgcaggcaggttgatcagccaggtatgattgggtcggtaggaagtgtcttgggtgaggagaacattaatgtcagtttcatgagtgtcggaaggattgctcctcgcaagcatgctgtcatggcaatcggtgttgatgaggaaccaagcaaggtcacactgagaaagattggggagattccagcaatcgaagagtttgttttcctcaagctttaggcaactaagcgcaaatgtatgtttcaagttgcaagcatgctgtgcaattttgatgtagcttagcaatatagaggacggatggttctccttaaataagcttttaggattatttttgtagtggcgctcttgaatttggtgcaatattgatgccatcttttgaacggggtgttattctcagctactgtttcccaggttataaaaaataatatgtactccacgttccaatttataaataaaaaaaaaaaaaaaa

SEQ ID NO: 34876 - protein, 612 aa, Zea mays
  misc_feature: Ceres CLONE 1413762
  misc_feature (175)..(350): Pfam Name: 2-Hacid_dh_C Pfam Description: D-isomer specific 2-hydroxyacid dehydrogenase, NAD binding domain
  misc_feature (73)..(382): Pfam Name: 2-Hacid_dh Pfam Description: D-isomer specific 2-hydroxyacid dehydrogenase, catalytic domain
  misc_feature (539)..(603): Pfam Name: ACT Pfam Description: ACT domain
  misc_feature: SWISSPROT Homolog: EC 1.1.1.95 Phosphoglycerate dehydrogenase
MAAPPATTATTHHRALLPPTRTHAAATHSALRLPLRAHPHAHAQRARLTAAAAPAPAASTASLESSAAGKPTVLVAEKLGAAGLALLREFANVDCSYGLSPEDLRAKISLCDALIVRSGTKVGRDVFEASGGRLRVVGRAGVGIDNVDLAAATEHGCLVVNAPTANTVAAAEHGIALLTAMAWNIAQADASLKAGKWQRNKYVGVSLVGKTLAILGFGKVGSEVARRAKGLGMHVIAHDPYASADRARAIGVELVSMEEAMTTADFISLHMPLTPATNKMLNDEAFAKMKYGVRIINVARGGVIDEDALVRALDSGIVAQAALDVFTKEPPAPDNKLVLHVNVTVTPHLGASTVEAQEGVAIEIAEAVIGALKGELAASAVNAPMVPAEVLSELAPFVVLAEKLGHLAVQLVAGGGGIKSVKVTYASARAPDDLDTRLLRAMITKGLIEPISSVFVNLVNADFTAKQRGVRITEERIILDGSPETPIDYIQVQIANVKSKFPSAISETGEITVEGRVKDGVPHLTKVGAFQVDVSLEGSLILCRQVDQPGMIGSVGSVLGEENINVSFMSVGRIAPRKHAVMAIGVDEEPSKVTLRKIGEIPAIEEFVFLKL

SEQ ID NO: 34877 - DNA, 673 bp, Zea mays
  misc_feature: Ceres CLONE 1413765-F
  misc_feature: Encodes the peptide sequence at SEQ ID NO. 34878
  misc_feature (500)..(500): n is a, c, t, g, unknown, or other
aaagctggagctccccgcggtggcggccgctctataactagtggatcccccgggctgcaggaattcgcacgagaccattacctagaacatcctaatcaaaaacacgcgaaggcacctagcagccgccactcgccgaactgaggaacacgccgggcgacgggatacagcagcagcgcgcccctctatgcccgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatggtcccnacccggaataggagcatcaaacatacaaggaccaaacttgccatgagagtcaacagtttcttgcgtcagctacacactcatcctactcttaataagttggttattaagttcgggcttgccaggaagcaccctcgcctgtccaacaaagggaatccctttctgctccggggccg

SEQ ID NO: 34878 - protein, 147 aa, Zea mays
  misc_feature: Ceres CLONE 1413765-F
  misc_feature (38)..(85): Pfam Name: F-box Pfam Description: F-box domain
MAKQKEGVDKRTARKMIRSTEGCAKSITFERNNKSDAVQLHDLPNDILGSILSRLTFRESSQMGLVSHTWRRLWRSCCRKLVFTSATMVPTRNRSIKHTRTKLAMRVNSFLRQLHTHPTLNKLVIKFGLARKHPRLSNKGNPFLLRG

SEQ ID NO: 34879 - DNA, 702 bp, Zea mays
  misc_feature: Ceres CLONE 1413771-F
  misc_feature: Encodes the peptide sequence at SEQ ID NO. 34880
tagagctggagctccccgcggtggcggccgctctatactagtggatcccccgggctgcaggaattcgcacgagaccattacctagaacatcctaatcgaaaaatcaagttttgtactgttgttagcgattctaccgtatgtctgatttgcactttattagtacttaactctctctttgatacatatgatatactactctggtcactgaacaatgtcgccttaaacactagtctgatttcaggctgggtatgttctttatctcctcttctggcaaccagaggagaaagctgtgcgctccaccccacaacaaatggatagaagtggcaactcgcctactactccccgttcttcacgtgatcaccaagaggagaatgaggaagctactacaccatcaaataagaaatctctagaatctgctctgcatgatccaattgagctgcccattctgctgaaacccctgctgacacaagaaaaatgtgcctggcggaccaaatgaaaatttggagactacctgaccgttggtttcccttatacctttccacggaaaagcctggtggcgaacccaaattttgaatctttcagctggtgtttcccccccccttttttaaccccccccaaaggggaaaccccccccccccaccaatttttttggtgagaatttccccccccatttataccggttttaaaaaaggggcactctcc

SEQ ID NO: 34880 - protein, 61 aa, Zea mays
  misc_feature: Ceres CLONE 1413771-F
MDRSGNSPTTPRSSRDHQEENEEATTPSNKKSLESALHDPIELPILLKPLLTQEKCAWRTK

SEQ ID NO: 34881 - DNA, 736 bp, Zea mays
  misc_feature: Ceres CLONE 1413773-F
aagctggagctccccgcggtggcggccgctctagaactagtggatcccccgggctgcaggaattcgcacgagaccattacctagaacatcctaatcaaaaaacgtctcgtcagtttttttccctttttcccgtggcccgtgggtgtgcgtcctaggtgtgcggcgggcggtgcgccgtgcgcctcctctcctcgccgcgacgctgccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgaataagacggtttgttctcgcatcgggcgtcagccggattcgagggacatagatgatggaagtcgatcttgggtgccaccacgtcgaagcggcttgtgctgtgtagatccggcgaaagcgcgcaggcaaagcccgggtctgcgtcgtcattggcctcatgatcttcgtattgccatcgcgctaaagggaacgaaggcgacgaggtcttaaactttgattgatatatgcggatatgaaaatgcatgcaactacatgctagaagtctgtcttgggtgtgttggagaaaaattcttggttacgtttttgttgatagtggtgagtgccaaaatggagctc

SEQ ID NO: 34882 - DNA, 729 bp, Zea mays
  misc_feature: Ceres CLONE 1413774-F
  misc_feature: Encodes the peptide sequence at SEQ ID NO. 34883
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaagcactctcctccccgctctcgacttcccatcccctgcggccccgccccccgactcttctcgtcgcggcgcgcccaatcggctcggtggcaggcttgcgcaccggctcggctcgggtccggttctaccgccaacgcgggccgccgcgctcccggatctcggtctagtcagagagttagcagacaaagatggcgacttatgagcccaagaacattctcataactggtgctgctggtttcattgcatcgcatgtcgccaaccgtctggtcaggaactatccccaatacaagatcgttgtccttgacaagattgactactgctccaacctaaagaacctcaatccttcacggtcttcaccaaatttcaaatttgtcaagggtgatattgcaagtgctgacctggtgaattaccttctgatcaccgagtcaattgacaccatcatgcactttgctgcccagacgcatggtgataattcttttggcaattcattttgagtcacaaaaaacatatatattgccacccatgntcttcttgaaggcttgcaaaggtactggtcagatcaggaagtttattcctgtcaatacccaccaggtggattgtggaaactgaagaaaatgctgggggttgga

SEQ ID NO: 34883 - protein, 101 aa, Zea mays
  misc_feature: Ceres CLONE 1413774-F
  misc_feature: SWISSPROT Homolog: EC 4.2.1.46 dTDP-glucose 4,6-dehydratase
MATYEPKNILITGAAGFIASHVANRLVRNYPQYKIVVLDKIDYCSNLKNLNPSRSSPNFKFVKGDIASADLVNYLLITESIDTIMHFAAQTHGDNSFGNSF

SEQ ID NO: 34884 - DNA, 754 bp, Zea mays
  misc_feature: Ceres CLONE 1413776-F
  misc_feature: Encodes the peptide sequence at SEQ ID NO. 34885
  misc_feature (633)..(633): n is a, c, t, g, unknown, or other
  misc_feature (698)..(698): n is a, c, t, g, unknown, or other
  misc_feature (754)..(754): n is a, c, t, g, unknown, or other
aaagctggagctccccgcggtggcggccgctctagaactagtggatcccccgggctgcaggaattcgcacgagaccattacctagaacatcctaatcgaaaaaatcgaaaccaacagtgaatcagccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggaggcctgcagcagcggcgggccctgtaccagccccgcctcccgccatgcctccagggaccgacggtaagggcggagtacggtgacgcgaccacaaccatcgatcccacctgtgcccaagccgtcgcgcaggccttcccgcacacctttggccagccgctcgtcagcttcgtcgcgccggccgccggcgccggcgccgttgaggagcgccacccgatcagggtgggcgtggtgttctctgggaggcagtcgccgggagggcacaacgtcgtctggggcctccatgacgcacttnaagcctacaatcctcagagcttgctctacggatttcgtcgtggcacggagggactgtttgcaaancagacgttggagatcacagacgatggtcttgcttcctataagaaccaaggtggttn

SEQ ID NO: 34885 - protein, 150 aa, Zea mays
  misc_feature: Ceres CLONE 1413776-F
  misc_feature: SWISSPROT Homolog: EC 2.7.1.90 Diphosphate--fructose-6-phosphate 1-phosphotransferase
  misc_feature (111)..(111): Xaa is any aa, unknown, or other
  misc_feature (132)..(132): Xaa is any aa, unknown, or other
MNADFGAPKELAGGLQQRRALYQPRLPPCLQGPTVRAEYGDATTTIDPTCAQAVAQAFPHTFGQPLVSFVAPAAGAGAVEERHPIRVGVVFSGRQSPGGHNVVWGLHDALXAYNPQSLLYGFRRGTEGLFAXQTLEITDDGLASYKNQGG

SEQ ID NO: 34886 - DNA, 659 bp, Zea mays
  misc_feature: Ceres CLONE 1413780-F
  misc_feature: Encodes the peptide sequence at SEQ ID NO. 34887
  misc_feature (544)..(544): n is a, c, t, g, unknown, or other
  misc_feature (609)..(609): n is a, c, t, g, unknown, or other
  misc_feature (659)..(659): n is a, c, t, g, unknown, or other
aaagctggagctcaccgcggtggcggccgctctagaactagtggatcccccgggctgcaggaattcgcacgagaccattacctagaacatcctaatcgaaaacagtcccagtcccagtcccagtcccaggacagtcccgtcagcagccacttccccggcccctcccgctcctgctcgccggaggccgggccggcggcgatggggcacggcgctagctgcggccgaccaagcgaggaggtagacttcttcggcgcggcgcagtccggggacatggcccgcctcgccgccgctcttcgctcccgccccaccttgctcagccgcaccacgctcttcgaccgcctctccgcgctccacatcgccgccgcacacggccacctccaggtggtctccctggcattggatctttgcgtgcaccccgacgtcgttaaccgccacaagcagacggcgttgatgctctcggcgatgcacgggaagaccgactgcgtccgccggctgctcgacgccggcgccaatatcgtgatgttcgattcctcgcacggggggnacgtgcctgcactacgcagcgtactacgggaacgcggactggcttcggaccatcctctcgggggnggccaagttccgggccggtctcgaaatcctggggggttcgcccgctttcn

SEQ ID NO: 34887 - protein, 153 aa, Zea mays
  misc_feature: Ceres CLONE 1413780-F
  misc_feature (79)..(111): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 3.6.1.22 NAD(+) diphosphatase
  misc_feature (116)..(116): Xaa is any aa, unknown, or other
MGHGASCGRPSEEVDFFGAAQSGDMARLAAALRSRPTLLSRTTLFDRLSALHIAAAHGHLQVVSLALDLCVHPDVVNRHKQTALMLSAMHGKTDCVRRLLDAGANIVMFDSSHGGXVPALRSVLRERGLASDHPLGGGQVPGRSRNPGGFARF

SEQ ID NO: 34888 - DNA, 571 bp, Zea mays
  misc_feature: Ceres CLONE 1413782-F
  misc_feature (118)..(118): n is a, c, t, g, unknown, or other
  misc_feature (225)..(225): n is a, c, t, g, unknown, or other
  misc_feature (289)..(289): n is a, c, t, g, unknown, or other
atagctggagctccccgcggtggcggccgctctagaactagtggatcccccgggctgcaggaattcgcacgagaccattacctagaacatcctaatcgaaaactgattacaaacccgntcctctgtccgtcctaccaccaccgctcacctcggtttggctttctcccctcttccgcacccgcttctcgctccggattccggattccctctgctctttccctaacngaagggtagcatgggcgggagaggtaggcgatcggctccagcgccgcaagaagccacgtccagnagctccaagggtgggctccagttcccctggggggaaaaggtcccccaaggttcccccaaggccgggaaaaattcccaaaagaaattggcgcgggccccccggttaaaccccggggggggggggaaaaaattttgtgggggggggggtttttaaaggggcgcccccaatggggcgccccaaaaaaaaaaaaaaaaaccccccttttgtggccccccccctcatttttttttgtgcccgggtaaaaaaaaaaaaaaaaaactccccccccccccgggggggggg

SEQ ID NO: 34889 - DNA, 670 bp, Zea mays
  misc_feature: Ceres CLONE 1413789-F
  misc_feature: Encodes the peptide sequence at SEQ ID NO. 34890
aagctggagctccccgcggtggcggccgctctataactagtggatcccccgggctgcaggaattcgcacgagaccattacctagaacatcctaatcgaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctaggcgccgacaaggtcgtcgggaccgagctggaggtcggcagggacggcaaggccacgggcttca

SEQ ID NO: 34890 - protein, 163 aa, Zea mays
  misc_feature: Ceres CLONE 1413789-F
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGRRYVVTASPRVMVEPFARAFLGADKVVGTELEVGRDGKATGF

SEQ ID NO: 34891 - DNA, 661 bp, Zea mays
  misc_feature: Ceres CLONE 1413791-F
  misc_feature: Encodes the peptide sequence at SEQ ID NO. 34892
  misc_feature (276)..(276): n is a, c, t, g, unknown, or other
  misc_feature (293)..(293): n is a, c, t, g, unknown, or other
  misc_feature (381)..(381): n is a, c, t, g, unknown, or other
  misc_feature (422)..(422): n is a, c, t, g, unknown, or other
  misc_feature (423)..(423): n is a, c, t, g, unknown, or other
  misc_feature (465)..(465): n is a, c, t, g, unknown, or other
aaagctggagctccccgcggtggcggccgctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccangcttccttggctggcgntctccgacctccagctccgctacttcggcaacagccggccccgccgccgcaggggctccgctctacctctccctctccgcccggtggncgcgcactctgctcggattgctggtgagatgccccaagccnnttgtgatctagatgatggtgtgcaacacaccctgactaattngcacagtattcacaaaagcttactattttggcagcccagggctgaggaaccaatctcagaaagggtactttatgaaatttgaaaaaggtcaagggcctttgttgatgcaactttccaacactccctagactcggaaagaatggacccccctgccaaaaaaattttgcatccggcatccgaattgggggcaacaaaa

SEQ ID NO: 34892 - protein, 136 aa, Zea mays
  misc_feature: Ceres CLONE 1413791-F
  misc_feature (47)..(47): Xaa is any aa, unknown, or other
  misc_feature (53)..(53): Xaa is any aa, unknown, or other
  misc_feature (82)..(82): Xaa is any aa, unknown, or other
  misc_feature (96)..(96): Xaa is any aa, unknown, or other
  misc_feature (110)..(110): Xaa is any aa, unknown, or other
MATSPPQNPSSGEPSDASSLAAAALEAPVRVWRSLVARFPPLPDSSXLPWLAXSDLQLRYFGNSRPRRRRGSALPLPLRPVXAHSARIAGEMPQAXCDLDDGVQHTLTNXHSIHKSLLFWQPRAEEPISERVLYEI

SEQ ID NO: 34893 - DNA, 755 bp, Zea mays
  misc_feature: Ceres CLONE 1413792-F
  misc_feature: Translation starting site: 244
  misc_feature: SWISSPROT Homolog: EC 5.5.1.4 Inositol-3-phosphate synthase
  misc_feature (208)..(208): n is a, c, t, g, unknown, or other
  misc_feature (432)..(432): n is a, c, t, g, unknown, or other
  misc_feature (564)..(564): n is a, c, t, g, unknown, or other
  misc_feature (567)..(567): n is a, c, t, g, unknown, or other
  misc_feature (617)..(617): n is a, c, t, g, unknown, or other
  misc_feature (618)..(618): n is a, c, t, g, unknown, or other
  misc_feature (693)..(693): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcaaaaaacacacagctcaacaaaggagcgcggcggcccctcattccttcctcccacttctctcgcgctgcgctcgcttacctcgcttcgcattccgttcgagcaggggagcnggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgccgtccccaagctcggngtcatgcttggtggggtggggaggcaacaacgggtccacgctgacggctggggtcattgccaacagggaggggatctcatgggcgacccaaggacaggtgcagcaagccaactactacggctccctcacccnagncttcaccatcagagtaggcagctaccacggggaggagatatatgcgccgnntcagagcctcctacccatggtgaacccagacgaccttgtgtttggagggtgggacatcagcagcatgaacctggnagatggcatgacccaggccaaggntgctgacattgacctgcagaacagctcaggccctactg

SEQ ID NO: 34894 - DNA, 761 bp, Zea mays
  misc_feature: Ceres CLONE 1413798-F
  misc_feature (296)..(296): n is a, c, t, g, unknown, or other
  misc_feature (319)..(319): n is a, c, t, g, unknown, or other
  misc_feature (336)..(336): n is a, c, t, g, unknown, or other
  misc_feature (344)..(344): n is a, c, t, g, unknown, or other
  misc_feature (351)..(351): n is a, c, t, g, unknown, or other
  misc_feature (491)..(491): n is a, c, t, g, unknown, or other
aaagctggagctccccgcggtggcggccgctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatncgatatgccgttcggccacaccncggctccaatgtccggnggtcccgnccgcagncgtcctacctctgctgctccacaacccaccctcgtcgccgtattcgtcgcgctctgccctgggtggcttgtggggggaaaggggggtcctccatggtcgttaaccccccttggcgaaagttccccccccctttttcaaanccccaaaaggggcgtcaccctgaggctcatgaacctccttcctgccaccgaaagcttaccccaatgtttgattcagggaaggggatccccacccccttgatgggtcccccacctgtttaacaaaaaatttgccttccgttaaaaaaaaaaaaagtgggtgtggtggaaataacaacacaaactttttccctaaaaaaagcggggccctggggcaaccaaggttgaaacatttaaaaaggcgcttaaagaaaaaaccttgaacccccagac

SEQ ID NO: 34895 - DNA, 682 bp, Zea mays
  misc_feature: Ceres CLONE 1413799-F
  misc_feature: Encodes the peptide sequence at SEQ ID NO. 34896
aagctggagctccccgcggtggcggccgctctataactagtggatcccccgggctgcaggaattcgcacgagaccattacctagaacatcctaatcgaaaaaagagcgtgcagagcgagacgcgtcgcctcctcccttcccccaccccgccgccgccctcgcgtccgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcggccggcggtggcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgcgctgttcactgcactctttagcactgtgtccttcttgcttggagccatcacctctctggtctctggtttccttggcatgaagattgcac

SEQ ID NO: 34896 - protein, 160 aa, Zea mays
  misc_feature: Ceres CLONE 1413799-F
  misc_feature: SWISSPROT Homolog: EC 3.6.1.1 Inorganic diphosphatase
MAILSALATEVLIPVAAVIGIAFAVVQWVVVSRVKLSPAAAGGGGGKAGYADSLIEEEEGLNDHNVVVKCAEIQNAISEGATSFLFTEYQYVGIFMAIFAVVIFLFLGSVEGFSTKSQPCTYSKDKYCKPALFTALFSTVSFLLGAITSLVSGFLGMKIA

SEQ ID NO: 34897 - DNA, 686 bp, Zea mays
  misc_feature: Ceres CLONE 1413800-F
  misc_feature: Encodes the peptide sequence at SEQ ID NO. 34898
caaagctggagctccccgcggtggcggccgctctataactagtggatcccccgggctgcaggaattcgcacgagaccattacctagaacatcctaatcaaaaaagagacaaacacttcaggattcagcagtagctaatcgagccatccttgcctaagctcctctcctcttctctccgtcgtcgcggaacttctctccgccggctgccatatataggagaagaagagaacagcaacgctaggtaggcgggcggcctccatcgccgccgtcgtcgactagctatctaaatctcgatctccagctcctgccccccaactccgtcgtcagcgatggtaggaggcctcttctccatggatcacccggtcatcaccctctccggcatcgcaggaaacatcatctccttcctggtgtaccttgcaccagtggcgacgttcctgaaggtgtaccggaagaagtcgacgagaggattcagctcggagtcgtacgtggtggagctcttcagctcggtgctgcggatcttctacgcggtggagaagaccaactcgagggcgctgctgaccatcaacgtcttcgactgcgacgtggacgttgcctacatagtcctctacctggagtacgcgccgcggcgagcgcgcctgcagactctgggctacttcttcctgctggacgtggcggacttcgcgctcg

SEQ ID NO: 34898 - protein, 119 aa, Zea mays
  misc_feature: Ceres CLONE 1413800-F
  misc_feature (14)..(101): Pfam Name: MtN3_slv Pfam Description: MtN3/saliva family
MVGGLFSMDHPVITLSGIAGNIISFLVYLAPVATFLKVYRKKSTRGFSSESYVVELFSSVLRIFYAVEKTNSRALLTINVFDCDVDVAYIVLYLEYAPRRARLQTLGYFFLLDVADFAL

SEQ ID NO: 34899 - DNA, 750 bp, Zea mays
  misc_feature: Ceres CLONE 1413812-F
  misc_feature: Encodes the peptide sequence at SEQ ID NO. 34900
  misc_feature (503)..(503): n is a, c, t, g, unknown, or other
  misc_feature (513)..(513): n is a, c, t, g, unknown, or other
  misc_feature (514)..(514): n is a, c, t, g, unknown, or other
  misc_feature (552)..(552): n is a, c, t, g, unknown, or other
  misc_feature (573)..(573): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcgaaaagcacacactgtcttagtgtctttctctgcctttctttccctagcgccgcgccggcgccgccattcgatcagtcttcgtcggccgcttcgccggcgacagcatactccagtcggttggttttggcacttcggaccggcggccatggcttccgacggcatcggccccagagatgtatgtgttgttggggttgcacgcaccccaatgggcggtttccttggtgccttgtctcccttgcctgctacgaaacttggctctatagtaattcaagctgctctggaaagagcaaacgtggatccagccctcgtgcaggaggtctactttggaaacgtattgagtgctaatttggggcaagctcctgcaaggcagctgctctgggtgcccggataccaactctgttgttngcaccactgnntacaagtctgtgcatctggcatgaaagctactatgttngcagcacagtcaattcatggnngtatcatgatattggtgtgcctggtggcatggaaagcatgtccaatgccccaagtacattgctgaaactaggaaggggtctcgttttggtcatgaccaccttgttgatgcatgcttaaggatgggctttgggatgtatacatgatgggccatgggaatgggggccaactttggcta

SEQ ID NO: 34900 - protein, 131 aa, Zea mays
  misc_feature: Ceres CLONE 1413812-F
  misc_feature (8)..(132): Pfam Name: Thiolase_N Pfam Description: Thiolase, N-terminal domain
  misc_feature: SWISSPROT Homolog: EC 2.3.1.9 Acetyl-CoA C-acetyltransferase
  misc_feature (87)..(87): Xaa is any aa, unknown, or other
  misc_feature (90)..(90): Xaa is any aa, unknown, or other
  misc_feature (91)..(91): Xaa is any aa, unknown, or other
  misc_feature (103)..(103): Xaa is any aa, unknown, or other
  misc_feature (111)..(111): Xaa is any aa, unknown, or other
MASDGIGPRDVCVVGVARTPMGGFLGALSPLPATKLGSIVIQAALERANVDPALVQEVYFGNVLSANLGQAPARQLLWVPGYQLCCXHHXXQVCASGMKATMXAAQSIHGXIMILVCLVAWKACPMPQVHC

SEQ ID NO: 34901 - DNA, 673 bp, Zea mays
  misc_feature: Ceres CLONE 1413819-F
  misc_feature: Encodes the peptide sequence at SEQ ID NO. 34902
  misc_feature (631)..(631): n is a, c, t, g, unknown, or other
aagctggagctccccgcggtggcggccgctctagaactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggncgacgccgacccggctcagcggaagatcttcgtacacggcct

SEQ ID NO: 34902 - protein, 131 aa, Zea mays
  misc_feature: Ceres CLONE 1413819-F
  misc_feature (118)..(118): Xaa is any aa, unknown, or other
MGKKRKLEPKSAAGFTPVKASPTTRSATAKAAGLSEVLAPVEATMEKLPQGAGGEDVEEIEEVEVEEEVEVEEEEEGESDQASIQALLDSFPKDQLVELLRDAAIAHGDVLTTIRRVXDADPAQRKIFVHG

SEQ ID NO: 34903 - DNA, 633 bp, Zea mays
  misc_feature: Ceres CLONE 1413826-F
  misc_feature: Encodes the peptide sequence at SEQ ID NO. 34904
aaagctggagctccccgcggtggcggccgctctagaactagtggatcccccgggctgcaggaattcgcacgagaccattacctagaacatcctaatcaaaaaacagatccctctccactgtctcaccctttctctctcctcgaccctcccgacgcggcaaagcaaaaacacaaggaggagaggagggagagaaggaagaaggcgaggccaaaaatcccctccccctccccaaatcctagcccaataatctctcaatcaggggattcttaggtctgatcaagtcggaggattcggcagggcgcagccatgaacgagaaggcgtccgtctccaaggagctcaacgccaagcacaagaagatattggaaggtcttctacggcatcctgagaatagaggatgcgcagactgcaagtcaaagggccctcgatggggaagggggaaatctaggatctttatatggatggactggttctggaattcattaaaagcctgggggtggacaatatctaagggaaagaacctgccccccctggaaaaactgggctgcccaaagacaaggtggcatttattctcaaccaaggggggaacacgaaaaaagccaatatccttttgggggaaaaccaaaaccttgccc

SEQ ID NO: 34904 - protein, 109 aa, Zea mays
  misc_feature: Ceres CLONE 1413826-F
MNEKASVSKELNAKHKKILEGLLRHPENRGCADCKSKGPRWGRGKSRIFIWMDWFWNSLKAWGWTISKGKNLPPLEKLGCPKTRWHLFSTKGGTRKKPISFWGKTKTLP

SEQ ID NO: 34905 - DNA, 689 bp, Zea mays
  misc_feature: Ceres CLONE 1413832-F
  misc_feature: Encodes the peptide sequence at SEQ ID NO. 34906
gctctagaactagtggatcccccgggctgcaggaattcgcacgagaccattacctagaacatcctaatcgaaaaatcttttcctttcccctcctccctcctcggctcgtctctgttcccctttccctcctgcgcacccgtcttctcctccccgcgtcaaaccccagcacaaaaagcaaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaaaccacctcaagtacgagaagaaccccaagatcaaggaggccatccaccgcccagttcaccgagtaacctccgccgcggccgaggaaaatcccgggggggccctcaatgagggcgggccaagggcccgggggcccaacggggggggaacgaaatttgtcccccacccgcccccaaaaaacaaaggggcaagggacggggaaccgggggaaaacggaagggggaatactctcccaaaagaacccaagggttgaggggggggggcttcaactcccc

SEQ ID NO: 34906 - protein, 123 aa, Zea mays
  misc_feature: Ceres CLONE 1413832-F
  misc_feature (5)..(70): Pfam Name: MIT Pfam Description: MIT (microtubule interacting and transport) domain
  misc_feature: SWISSPROT Homolog: EC 2.7.11.1 Non-specific serine/threonine protein kinase
MYSNFKEQAIEYVKQAVQEDNAGNYVKAFPLYMNALEYFKNHLKYEKNPKIKEAIHRPVHRVTSAAAEENPGGALNEGGPRARGPNGGGTKFVPHPPPKNKGARDGEPGENGRGNTLPKEPKG

SEQ ID NO: 34907 - DNA, 774 bp, Zea mays
  misc_feature: Ceres CLONE 1413839-F
  misc_feature: Translation starting site: 195
  misc_feature (29)..(29): n is a, c, t, g, unknown, or other
  misc_feature (30)..(30): n is a, c, t, g, unknown, or other
  misc_feature (40)..(40): n is a, c, t, g, unknown, or other
ggtcccccccccccccccccccccccccnncaaaaatttntaacccccctccaaaactgggctccaccgcggtggcggccgctctagaactagtggatcccccgggctgcagtaattcgcacgagaccattacctaaaacatcctaatcaaaactccactgctctgctgctcctcgcgccgccgcagcgacgtaatggcttccgccgcggtgctccggaacgccggatcccggcgcctcttctcctaccctactctccgcgccgctgtgatatatgtaccttctgcgctacccgatgcgcccgcggcggcggcagcgccggaccagccgccaccgacggacgggaccctctgagagaggtctatggacaccatcacgcgcacgaagccccatgtgaacgtcggcaccattgggcacgtccgatcacggcaaaaccactctcactgctgccattaccaaggccccggacgaggcagggaacgccaaagccgattgctttcgacgagatccacaaagctccggaagaaaaaagccagaggaatcaccattgggaaaagcctcacgacaaagtatcaaaacggactaaaacggaattatgcctcacggtagaactgcccaagttccacgccgacttatgatatacaaaacctgaaaccatgggaacacgggtaaaaaagggattgctaggaaatcctttgtacccagaataaagttcctctaatgggccccccgatgcccacaaaaacccaaacgggatgcataactataatttctg

SEQ ID NO: 34908 - DNA, 668 bp, Zea mays
  misc_feature: Ceres CLONE 1413840-R
ccaattgggtaccgggccccccctcgaggtcgacggtatcgataagcttttttttttttttttttgacttttttttttttttttcttttttttgaaacttaatttgccccgtactatcaagtaatagatttcactttcacatcgagtcataataaaactcacaacaatacaacaaaagatttcttttactcggtcttcttctacttggctgattgccgagtcctggtaatgatggtatctatgtgcctcgatagtacattgtgggctacaccaaccttctcatcaatctcatcctggtacttctcatagagtggtggaaccaacagagagagcattacaccaatgtaaatgatcgtaaggaagttgaagagcattctaatgaatgaaaccacccacaaaatcaatatccccttttgcatcaaggagaacaaggataaggaagagcacacataattagaattagatatacaatagtctgagaaactaagaatctcagataaatatagacctttatagaaactttcctatctctcttgatggcaatgtcatggtcaacagccagcagcttattgatccatacaagagcgtgatctgcaactgaggtacccatttttgaagtacaaaactcgttgcctccacaacaggtaaacccgatgtggccaatcttc

SEQ ID NO: 34909 - DNA, 700 bp, Zea mays
  misc_feature: Ceres CLONE 1413840-F
  misc_feature: Encodes the peptide sequence at SEQ ID NO. 34910
aagctggagctccccgcggtggcggccgctctataactagtggatcccccgggctgcaggaattcgcacgagaccattacctagaacatcctaatcgaaaaccctcccccaccgccattgctcagcactagtactaaagccacgcctgacagacagatgatgcatttctggctgctggcttgcatgagcaagcctctcggcgcacgctgccataacagacagagagagatgcatgtgaacgacgtgctgctagtgacgctgctgccggcttctgctgccatgtgatgaagtcaatgctcaaacacaggtgtagtacacgatctccagcagtagccatccaaatgggcagcgaagggtacctgcttccagatgatccatgaaggacggccttcatgtagatgtagcctacctgccggcaaaattagggtacatcttgacgtggctagggaggagacgacctgcgtgaaggcacctgggatgacttcgtccaaagctcccggaaaaaaagggcccttgttcaatacccattcgaggaaatccccacccattttccctaaagggggggaaaatgccccgaaaattgggggcccaagcaccccggggggggttttttggcccaaaaaatttgcccaaaaaaaccgtaacacgggcggtttaacggggtttttcctaaaaataaagaggagaccccccaacctct

SEQ ID NO: 34910 - protein, 42 aa, Zea mays
  misc_feature: Ceres CLONE 1413840-F
MMHFWLLACMSKPLGARCHNRQREMHVNDVLLVTLLPASAAM

SEQ ID NO: 34911 - DNA, 722 bp, Zea mays
  misc_feature: Ceres CLONE 1413842-F
  misc_feature: Encodes the peptide sequence at SEQ ID NO. 34912
  misc_feature (1)..(1): n is a, c, t, g, unknown, or other
  misc_feature (298)..(298): n is a, c, t, g, unknown, or other
  misc_feature (340)..(340): n is a, c, t, g, unknown, or other
  misc_feature (349)..(349): n is a, c, t, g, unknown, or other
natagctggagctccccgcggtggcggccgctctagaactagtggatcccccgggctgcaggaattcgcacgagaccattacctagaacatcctaatcgaaaactactgtaggccgctgctgctcctctcctcccatctcaccacacaccgcagccccagcaagatcgcgcggaggccatggcgaagcccaagccttcctccgccggagccaagccgaccgcgcctgcgccgccggttacagtgcactcggcgctggacacctacacctacatgctcgcgctcctgtccctctgcccngccctcgtcatcctcctggtggaacacgatgggtgcacgcgnacgtatcgntggtgcggactaacgagcacctcaggaatcacgggggggtcgagggtctaaagcccatttggcccatgcccaccttcgtggggggaaagaacattctcgggtccggcttttcaaggcggccaaaaattgttttccctggaaaggcttataagggccctttgccccgggggaaaagggcggccaaacgggaaaggggttaaaaaaatttgggggcctgtaaatttctctgggggggggggggggggtttttttcccccccaaaaaggagagaacgcggggggaaaaaacacctcccttgttttggagaggttttttttttttttttttcttacagaggggggggggttttctccctttttgggggggggggggg

SEQ ID NO: 34912 - protein, 73 aa, Zea mays
  misc_feature: Ceres CLONE 1413842-F
MAKPKPSSAGAKPTAPAPPVTVHSALDTYTYMLALLSLCPALVILLVEHDGCTRTYRWCGLTSTSGITGGSRV

SEQ ID NO: 34913 - DNA, 749 bp, Zea mays
  misc_feature: Ceres CLONE 1413845-F
  misc_feature: Encodes the peptide sequence at SEQ ID NO. 34914
  misc_feature (19)..(19): n is a, c, t, g, unknown, or other
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (629)..(629): n is a, c, t, g, unknown, or other
gggcccccccccccccccnccccccctnggnntnnnnnactcttttccaaaagtggagctccccgcggtggcggccgctctatactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacggccaatggcggccgtggcaggcccactctgcacgtggctcgtcgccgcgtgcttgtctgcggcttgcgacgcagaagagtacaagcagaagcattgctgccccggcggaagcggcgctggggggcggcgtcaatgctcggnctggcgccgccgcctccggggcgccggcgtcgcggacttggcgccgcctcctggaatgcgctaatggctgtttgcctttaacaagcctgaaaagcaagtggtcattggaaaaagaaagaa

SEQ ID NO: 34914 - protein, 66 aa, Zea mays
  misc_feature: Ceres CLONE 1413845-F
  misc_feature (46)..(46): Xaa is any aa, unknown, or other
MAAVAGPLCTWLVAACLSAACDAEEYKQKHCCPGGSGAGGRRQCSXWRRRLRGAGVADLAPPPGMR

SEQ ID NO: 34915 - DNA, 671 bp, Zea mays
  misc_feature: Ceres CLONE 1413851-F
  misc_feature: Encodes the peptide sequence at SEQ ID NO. 34916
aaagctggagctccccgcggtggcggccgctctagaactagtggatcccccgggctgcaggaattcgcacgagaccattacctagaacatcctaatcgaaaaattttgccaatgcgacggtgaaatcccgcacctacctccttcctctctcaccgaggaccctcgcaccaagaactgagcggcaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgccttccctgatctatctagataatggcgaccacgacgtcagcgaccaccgccgcagcagcagccgccaccaccgccaagccgcgggggtcgtcgtcggccctctgccagagggtggccggcggcggcaggcggcgctccggggtggtgcggtgcgacgccgccggagtgtaggcccaggagcaggtcgtggcaaaggcggccagcgtcgccgtcctcgagcagatcaagatatccgccgaccgctacatgaaggaaaggagtaccatagctgtgatagggctcagtgtacacacagcaccagtggagatgcgtgaacaacttgctgttgcagaagaactgtgcc

SEQ ID NO: 34916 - protein, 49 aa, Zea mays
  misc_feature: Ceres CLONE 1413851-F
MATTTSATTAAAAAATTAKPRGSSSALCQRVAGGGRRRSGVVRCDAAGV

SEQ ID NO: 34917 - DNA, 681 bp, Zea mays
  misc_feature: Ceres CLONE 1413857-F
  misc_feature: Encodes the peptide sequence at SEQ ID NO. 34918
  misc_feature (623)..(623): n is a, c, t, g, unknown, or other
  misc_feature (624)..(624): n is a, c, t, g, unknown, or other
aaagctggagctccccgcggtggcggccgctctatacatagtggatcccccgggctgcaggaattcgcacgagaccattacctagaacatcctaatcgaaaagaaacacagcagacaggagcaacattcacggacggaaacccctcaaccccgaccccctcgaggcctcgacccgacccgacccgcctccaactccaagccaagccaccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgtcgactgctcctacggcctctcccccgaggacctccgtgccaagatctcgctctgcgacgcgctcatcgtcaggtccgggaccaaggtcggccgcgacgtcttcgaggcgtccggaggcaggctccgcgtcgtcggnncgcgccggtgtcggcatcgacaacgtcgaacttgccgccgccaccgagcacggatgc

SEQ ID NO: 34918 - protein, 157 aa, Zea mays
  misc_feature: Ceres CLONE 1413857-F
  misc_feature: SWISSPROT Homolog: EC 1.1.1.95 Phosphoglycerate dehydrogenase
  misc_feature (139)..(139): Xaa is any aa, unknown, or other
MAAPPATTATTHHRALLPPTRTHAAATHSALRLPLRAHPHAHAQRARLTAAAAPAPAASTASLESSAAGKPTVLVAEKLGAAGLALLREFANVDCSYGLSPEDLRAKISLCDALIVRSGTKVGRDVFEASGGRLRVVGXRRCRHRQRRTCRRHRARM

SEQ ID NO: 34919 - DNA, 674 bp, Zea mays
  misc_feature: Ceres CLONE 1413862-F
  misc_feature: Encodes the peptide sequence at SEQ ID NO. 34920
aagctggagctccccgcggtggcggccgctctagaactagtggatcccccgggctgcaggaattcgcacgagaccattacctagaacatcctaatcgaaaagttagctgtgcctgctcccatttggagggacgaagttttatcctgtggttactgcctgtcgatgtcaagcaatttttatgtactctagagattagtttggctgcatcctccgtatctttaccttgttgaccagggatggagcttgtatacatggaaaggagaaacggatcgtacgacgatggcgcggttccagagttcagtggaaggggggctggaggggatcaggatcaggacccgtccgctgctgcatccgaggtccagtctgactcgcgtcagacaccggacgagaagaagagcaagggctgccaatcatgccgtgacccattctgttcatgcagcggcggcacaccccactcggaactgttccccccacatcctgccaagatgatgatcctggagttcctcgtcgcgagcctcaggcacccgacaagaacccacaacatcagtgatctcgacgacctgatcgccgacggggtcagccaagggagcgtggtaaacctcggcccttctgagaagaaggtgctggaatctctgcacgccatggtaaacgccaagacgaggccgaagagcccg

SEQ ID NO: 34920 - protein, 146 aa, Zea mays
  misc_feature: Ceres CLONE 1413862-F
MELVYMERRNGSYDDGAVPEFSGRGAGGDQDQDPSAAASEVQSDSRQTPDEKKSKGCQSCRDPFCSCSGGTPHSELFPPHPAKMMILEFLVASLRHPTRTHNISDLDDLIADGVSQGSVVNLGPSEKKVLESLHAMVNAKTRPKSP

SEQ ID NO: 34921 - DNA, 677 bp, Zea mays
  misc_feature: Ceres CLONE 1413863-F
  misc_feature: Encodes the peptide sequence at SEQ ID NO. 34922
  misc_feature (483)..(483): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
tggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggcgccgaggtgtcggcggtggccgacaagggccggctcaagaagatcacgggcgtcaaggccaaggagatgctgctgtnggtcaccctccacgagatctgcgtcgacgacccgcccactggtaagctccactgcaaggccatcggcggcctgtcccgcagcttccccgtcgaggccttcgagggccgagagccggcgccgccccggagccgcgtgctcccccaggggacggagagaggagnnnnnnnnnnnnnnnnnnaaagggccccccccg

SEQ ID NO: 34922 - protein, 169 aa, Zea mays
  misc_feature: Ceres CLONE 1413863-F
  misc_feature (2)..(149): Pfam Name: DUF538 Pfam Description: Protein of unknown function, DUF538
  misc_feature (105)..(105): Xaa is any aa, unknown, or other
  misc_feature (159)..(159): Xaa is any aa, unknown, or other
  misc_feature (160)..(160): Xaa is any aa, unknown, or other
  misc_feature (161)..(161): Xaa is any aa, unknown, or other
  misc_feature (162)..(162): Xaa is any aa, unknown, or other
  misc_feature (163)..(163): Xaa is any aa, unknown, or other
  misc_feature (164)..(164): Xaa is any aa, unknown, or other
  misc_feature (165)..(165): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGAEVSAVADKGRLKKITGVKAKEMLLXVTLHEICVDDPPTGKLHCKAIGGLSRSFPVEAFEGREPAPPRSRVLPQGTERGXXXXXXXRAPP

SEQ ID NO: 34923 - DNA, 892 bp, Zea mays
  misc_feature: Ceres CLONE 1413864-F
  misc_feature: Encodes the peptide sequence at SEQ ID NO. 34924
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
nnnnnnnnnnnnccccccccccnnacccnanntnnatnnncgtatgacggccctttttttcaaagctggagctccccgcggtggcggccgctctacaatagtggatcccccgggctgcaggaattcgcacgagaccattacctagaacatcctaatcaaaacccatttttgaccttcaccagcgccaccttccacgccaaggctacgacgacaatggtggcgaggagcccgaacgccaagccggacaggcagaaggctgcagccctcgccgcggctgccgcgctcaacccggctctcctcagggagacgctcaagaaggttgaccgatgcatggcacggctgcaggagctgcagcacacggtagcccggcggcgcccaaggtcgtctcccggagtcaagtctcaagccccccgaaagcacgggcgggggtacctccccgggaccaccccccccggggggcaaaacgcaagaaaacccgccaaggaatgaagggggcggggagccgttccgccccccaaaaaaaaaaggtccccccccaaagcgggcacaaaagctcccgcggggggccgggcctttctcccttccgggaaaaaagagggcgcccctcactatagggggggagaaacaacaaaatgaggcccctccttcccccggcgcaaaatcgtgttggcctcggcgggaagaaaaaccgggggtaaataaagaacacatcgggggcaaggcccactctctcacgttcctcccgggggggaacaaatttgtgaggcgccgcccccccgcggggtcatcacaaaatgcgggggagcccccccggggagcacccaaaaaagcgggatccccaggaaaaaaaaaaaccgccgggggaggggaaaataacaccaccacccccccg

SEQ ID NO: 34924 - protein, 91 aa, Zea mays
  misc_feature: Ceres CLONE 1413864-F
MVARSPNAKPDRQKAAALAAAAALNPALLRETLKKVDRCMARLQELQHTVARRRPRSSPGVKSQAPRKHGRGYLPGTTPPGGQNARKPAKE

SEQ ID NO: 34925 - DNA, 838 bp, Zea mays
  misc_feature: Ceres CLONE 1413866-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
nnnnggcgattgggtaccgggccccccctcgaggtcgacggtatcgataagctttttttttttttttaatggccaagtacgaccatctcttctcatatcaatgataaaactttagatgtcttggtcacatcactcatctgcagcatgaaccgacatggctccttactttccttcccatatttttacccctccatgccggcgttggttaccagccggcccacaatgcacattatacttctcacttccatcgccggtacaacatggttcacttggctagcagcgaactcaagcggcaatgtatacccatttaatccaaaaccgcgggcgatcccagagctttaacgaacgctaccttaacggaccctcaacgttcatataaatgctggtgatgcgcgaatatactggttggcccaggctcctggctgctggacctaacgctctgtcactggcgatattcgcccttcatcggtacaggatactcttcttcctgaatgcacggatgttacgcatggacgcgatttctaaaggcttctctgaagtgtaaacttcctcctggatcggttcctcgtcagaaggcaccttcattgtgttcagctgaactgacggtgtacccaacattcgctggcggggtgaactcggtgccctagctcacttcacaaatgtggaccctgagttaccatacaattgtggagtgctcagagacgagaatctcatcggtatcatccgcagatggatctgagagatatctctcacacagtgtcacacgtggcgtaacgcagatcatcctccttgcagaggccttcaaacgggtaatgaacttcgtcccgggagcgatgtc

SEQ ID NO: 34926 - DNA, 674 bp, Zea mays
  misc_feature: Ceres CLONE 1413866-F
  misc_feature: Encodes the peptide sequence at SEQ ID NO. 34927
  misc_feature (26)..(26): n is a, c, t, g, unknown, or other
  misc_feature (31)..(31): n is a, c, t, g, unknown, or other
aaactggagctccccgcggtggcggncgctncatcataaaggaggcccccgggctgcaggaatccccacgagaccattacctagaacatcctaatcgaaaagcactcgcagttggtgtgcgctcccgtcctaaccaagcaaaacccgcaaccctagcctccgccggcgccgccatctgccggacctccctccggtcgaggacgaccgtaggctcacagcaccctaaccctatccctcccccgctgccgcgcgagtagggcaaaaaaatgccgcgtgagatcatcacgatccaggtggggaaatgcagaaaccacatcgtcatggagttctggaagcaggtctgtctcgagcacggaatcgataaggacgggctgctcgaggacttccccactcacgggggcgacaggaaggacctcttcttttaccaggctgatgatcagaacttcatacccaggtctctgcttatagacctgcagccgaaagtgatcgatggaatccagaacagtgagtacaggaacctgtacaaccacgagaacatatttgtcactgagcatagagctgctgccagaaacaactgtgccagtgggaatcatcaggcagaacaagttgatgatgatatcatggacatggctgacagacaaacagatggaagtgatagacttgacgcgcttgtc

SEQ ID NO: 34927 - protein, 136 aa, Zea mays
  misc_feature: Ceres CLONE 1413866-F
MPREIITIQVGKCRNHIVMEFWKQVCLEHGIDKDGLLEDFPTHGGDRKDLFFYQADDQNFIPRSLLIDLQPKVIDGIQNSEYRNLYNHENIFVTEHRAAARNNCASGNHQAEQVDDDIMDMADRQTDGSDRLDALV

SEQ ID NO: 34928 - DNA, 719 bp, Zea mays
  misc_feature: Ceres CLONE 1413869-F
  misc_feature: Encodes the peptide sequence at SEQ ID NO. 34929
aagctggagctccccgcggtggcggccgctctataactagtggatcccccgggctgcaggaattcgcacgagaccattacctagaacatcctaatcgaaaaaatttccacttcagtaagagggcacctcctccccctttcggtacgcactcatgggaaaccgtgcgtcgcgccaccaccgccacgtcaccgagcagcagtcagagacaccgacccttcgcaagacccagatccagccgccgcccccgccgacgtagacgtattacagcagcatgtctcgcacgcgtctaacctgaaccggcgacccacgcaagtctctgctccgcgtgctcggcccccccctgtaagacgaaaggtgaccaaaacctttcggaccccaggtccgaagggttcactgagggttaaactaactgggttcccgacggggaaaaaggggaaaccttttccctggaattcctttccccccgggaattgggaccccccggggaccacatccgaagaaggggggggggggggaaaatttttttcccccccccccgaaaccgagaaaaaaaaaaaatttttggggtcccttaaaaggggggcgcccccccccccctttttggggtctctcaaaggggggagaagccccccccccttttatagaggggacacaaaagggggggggggctccctttttttttgagaaaaaaaccgcggaaaaaacaccacccaaatggg

SEQ ID NO: 34929 - protein, 34 aa, Zea mays
  misc_feature: Ceres CLONE 1413869-F
MGNRASRHHRHVTEQQSETPTLRKTQIQPPPPPT

SEQ ID NO: 34930 - DNA, 864 bp, Zea mays
  misc_feature: Ceres CLONE 1413877-F
  misc_feature: Encodes the peptide sequence at SEQ ID NO. 34931
  misc_feature (13)..(13): n is a, c, t, g, unknown, or other
  misc_feature (14)..(14): n is a, c, t, g, unknown, or other
tccccttcccccnnccttcctccccctccccccctgggatagtttcaaactggaactccaccgcggtggcggccgctctaaaatagtggaaccccgggctgcaggattcgcacgagaccattacctagaacatcctaatcgaaataagaagagatgcgctgcgctgcaacgggcggcgggtgcgtcgcttcgtggagcggcgattggagattgccggcggtcaacccctgcagcgtgcggatgccgacgggcaccgaatgggtggtgcgccggcctgaggtcgcgggcggcgtatctcgccggcctcgagatggccaacctgcgcggcgccgtcggggggatccttcccacaggaggcccgcgctaacaggccgcttggcaagcccacgggggccagcttgcacccctaaactttactttccctttggaagcacgcgctcaggttaaatccctccagggacagtgtcccggcccatatcgtggggcgtgggcctttgcccagggggggcgtatttctggcgccggtttacccaccccttggaccggggcgcccaacgcacccccccatcagaaaacaccccccccgcaacgcgacacccctggcgcaattctgttgaacacaaggccttgtcctttagaaccgagcgcgacggggggattacggacacctctcccttggtcgtggctgccataaccccagtaggcccccttttcaacgcggttttcccccctttccgccaacaaaatactctccggcggggcccaagagaaaccatcgcttcctcgggaattcggagtgtcccacttgtggatccaagggggccactttcttgacaggccgtaacaaacccccgcacagacccc

SEQ ID NO: 34931 - protein, 97 aa, Zea mays
  misc_feature: Ceres CLONE 1413877-F
MRCAATGGGCVASWSGDWRLPAVNPCSVRMPTGTEWVVRRPEVAGGVSRRPRDGQPARRRRGDPSHRRPALTGRLASPRGPACTPKLYFPFGSTRSG

SEQ ID NO: 34932 - DNA, 648 bp, Zea mays
  misc_feature: Ceres CLONE 1413880-F
  misc_feature: Encodes the peptide sequence at SEQ ID NO. 34933
  misc_feature (306)..(306): n is a, c, t, g, unknown, or other
  misc_feature (332)..(332): n is a, c, t, g, unknown, or other
  misc_feature (333)..(333): n is a, c, t, g, unknown, or other
  misc_feature (351)..(351): n is a, c, t, g, unknown, or other
  misc_feature (356)..(356): n is a, c, t, g, unknown, or other
  misc_feature (423)..(423): n is a, c, t, g, unknown, or other
  misc_feature (431)..(431): n is a, c, t, g, unknown, or other
aaagctggagctccccgcggtggcggccgctctagaactagtggatcccccgggctgcaggaattcgcacgagaccattacctagaacatcctaatcgaaaaacagtaggttcattccccccaccacatcgaactgtgcgcgcgctgcgcggtcggtcgctcccctcctctgtccgcgatctcggctggccgcctgggcttggccctcgccaccgctcccgtctccggttccggcggccgagccaggtttgctcgggtcttcgtggcagcgacgatgaaggacaagcgtgggctcgaggacgccgncgacgggcgccctgatgccaagaggnncgcgcctccggctctggncagtngtattgttgaaagcgtaaaagtggatagtctgcagaggctctgctcatcattgaaacaatttcttcntaaagtantcagggaaaaaggggaaggcgcacttggacaaactgggccctggaacaatcgggggaaagccttcccccaaggggattgaaggccccaagggaaaaacctcgaacccggaatcccaaaaaagggtgccctttcccttttttttggagaaaaattttaagggggaaccggggccctcaacccgggtttttttttaaaaggcacccccgggggggttat

SEQ ID NO: 34933 - protein, 78 aa, Zea mays
  misc_feature: Ceres CLONE 1413880-F
  misc_feature (11)..(11): Xaa is any aa, unknown, or other
  misc_feature (20)..(20): Xaa is any aa, unknown, or other
  misc_feature (26)..(26): Xaa is any aa, unknown, or other
  misc_feature (28)..(28): Xaa is any aa, unknown, or other
  misc_feature (50)..(50): Xaa is any aa, unknown, or other
  misc_feature (53)..(53): Xaa is any aa, unknown, or other
MKDKRGLEDAXDGRPDAKRXAPPALXSXIVESVKVDSLQRLCSSLKQFLXKVXREKGEGALGQTGPWNNRGKAFPQGD

SEQ ID NO: 34934 - DNA, 715 bp, Zea mays
  misc_feature: Ceres CLONE 1413886-F
  misc_feature: Encodes the peptide sequence at SEQ ID NO. 34935
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (27)..(27): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
gtgttccccctctctattnnncnnannccannnannananntttnnnnnnnacaaaactggagctccccgcggtggcggccgctctagaatagtggatcccccgggctgcaggaattcgcacgagaccattacctagaacatcctaatcgaaaaaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcgccccgcgcgtccccgcccgcgtctaccaacggcgccgccaccgcgcttggaccccccgtgtccgcctcctttgcccgtgaccgcgccgaggacctgcaggccgaggcccgcgcgatggcccgcgccgctggcgccacagtctacagtcccgagctcctcgccgcccgctacggctcccgccccttcaaggcggcgctccgggcaggagaggtgctgtccaagttgtcgtcgttcggcgcgacggcctactgcacgagcggagaggggagacgtcatcgaagagaggcgcgcccgggcggtgcagctgcgcaccatcttcactaggctcggcccgaccttcgtcaaattggacagga

SEQ ID NO: 34935 - protein, 69 aa, Zea mays
  misc_feature: Ceres CLONE 1413886-F
MARAAGATVYSPELLAARYGSRPFKAALRAGEVLSKLSSFGATAYCTSGEGRRHRREARPGGAAAHHLH

SEQ ID NO: 34936 - DNA, 785 bp, Zea mays
  misc_feature: Ceres CLONE 1413888-R
  misc_feature (1)..(1): n is a, c, t, g, unknown, or other
  misc_feature (21)..(21): n is a, c, t, g, unknown, or other
  misc_feature (785)..(785): n is a, c, t, g, unknown, or other
ntttggggttggttttttttntgtgtgttttttttgagggtccttactttggtgtctaattgcgtacgggccccccctcgaggtcgacggtatcgataagcttttttttttttttttttattttttttttttttttggcaaattcgctctttcaaatttcatgatcatctcattcatcatctcaccaaattccaactaagacaacgttcatgtccatccgcctcatcatctacctatccaaccaaacagcaaagtctcattgtgttgagcttggcgtgtcgactccatggaacttcctcccggcttcgatggcctccctgaatgcgttgaccagctccgtgttctctggctcaagttgcaccccctcatagaaagagtttgcggcttcctcaaacctctgtaacagacgatgcgccgctccttccctgtagcaggctttcgcccaaactggtctcaatgcacggcatgctttggcgtcctccagagtacgctcatgttgtccttgcccgcagccagctaaagcttctgtttgagagcactgttgcatcagttgggtccaacttctgtagccctgcctataaacattccccgcctacaaggttaattcctttcttttttaacgggatcattcaccctcccgaattttgggcttcccaaaggaaccccttttttatggctttcaaaaatgaaaaccctcccaattatcttctgttgttttaagaccactgaaattttccaaaaaaatatgttccgctcttcccccttcagaatctgtaacaaacttn

SEQ ID NO: 34937 - DNA, 667 bp, Zea mays
  misc_feature: Ceres CLONE 1413889-F
  misc_feature: Encodes the peptide sequence at SEQ ID NO. 34938
aagctggagctccccgcggtggcggccgctctagaactagtggatcccccgggctgcaggaattcgcacgagaccattacctagaacatcctaattgaaaaacacaaaagagagaaccggcggcgagctaggagctagccatggacggacacggcgcggtctcaccgtggagcgtgctaggcggggcgtcggctgtgctgctcctgtggttgacgtcgcaggtgctggagtggacctggtgggcgccccggcgcgtgaaccgtgcgctgagggcgcagggcctgaggggcacccggtaccgcctcctctgcggcgacctcatcgaggagcagcgtctccgcgcggcgaccctggcaaggcccgtccccgtggatcggccacacgacttcgtccctcgcgtcgcgcctttccttcaccgcgtcctccaagagcacgggaagctctcgtttacatggtttgcgccgaccccaagagctctaatcaccgatcccgagcttgcccggcaagtgctgtctaataagtgcggcgacttcgagaagtcgctgctctctcccctgtcaacgctgctggttgctgggctcgtcgtccttgacggtgaaaagtggatctagcatcgaaggatcctgaatccgccattccacgcgtagaacctgaagggtatgctgcc

SEQ ID NO: 34938 - protein, 156 aa, Zea mays
  misc_feature: Ceres CLONE 1413889-F
  misc_feature: SWISSPROT Homolog: EC 1.3.3.9 Secologanin synthase
MDGHGAVSPWSVLGGASAVLLLWLTSQVLEWTWWAPRRVNRALRAQGLRGTRYRLLCGDLIEEQRLRAATLARPVPVDRPHDFVPRVAPFLHRVLQEHGKLSFTWFAPTPRALITDPELARQVLSNKCGDFEKSLLSPLSTLLVAGLVVLDGEKWI

SEQ ID NO: 34939 - DNA, 634 bp, Zea mays
  misc_feature: Ceres CLONE 1413894-F
  misc_feature: Encodes the peptide sequence at SEQ ID NO. 34940
  misc_feature (634)..(634): n is a, c, t, g, unknown, or other
aagctggagctccccgcggtggcggccgctctagaactagtggatcccccgggctgcaggaattcgcacgagaccattacctagaacatcctaatcgaaaaaagaactcggaagtccgaagcagagcaagggatggatagcaagtcggtgggaatcgtcggcgcacgcgtgagcggcctagcagcctgcaagcacgccctcgacaaggggttcaggccgctggtgttcgaggccgacgggagcgttggcggagtgtgggcgcacaccctgtagtccacgaggctccaggcgccgacgacggcgttccggttctcggacctggcgtggccgccggagagcgccagggaggcgtacccaggccaccgcagggtcatggagtacataaagtcgtacgcgcgtgcgttcgacctcctcaaggacatcaggttccacagccaggtgctgggcgtcgagtacctcggtgcgaccgaggaagaggtcatgtgctggcatcagtggtccggcgatgggacggcgatcggagccgtgtaggatggcggatgacgcctcaccgcccaggacttgaaagtcggtagcactgaggttttttgtggtggattttctcatcctgagcattgggaggcacagtgagacn

SEQ ID NO: 34940 - protein, 46 aa, Zea mays
  misc_feature: Ceres CLONE 1413894-F
  misc_feature: SWISSPROT Homolog: EC 1.14.13.8 Flavin-containing monooxygenase
MDSKSVGIVGARVSGLAACKHALDKGFRPLVFEADGSVGGVWAHTL

SEQ ID NO: 34941 - DNA, 748 bp, Zea mays
  misc_feature: Ceres CLONE 1413897-F
atagctggagctccccgcggtggcggccgctctagaactagtggatcccccgggctgcaggaattcgcacgagaccattacctagaacatcctaatcgaaaaaaacaacgccgcgacgagaagagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctggggcgcggcgttcgccgccggatctggggcgcgggacggtgccccggaacggccgatggggcggcgggtgggcgctcccggttgggcgcccgccgcgctcgcgggttctcgtccttcgtgtcagtggctctgcttccccttgtcagttccgacgatggacacaaacactggcgagggtgttgtcaggggctgggcggattcctccacggggcgcgtgaagggacggggacaacctgagcctcaaggatttgctcttcttcctcacattcctaggactggaggccgcacctactttcatgggatgccagcgttctatggaaactacggtccgaccaagccttctgattgg

SEQ ID NO: 34942 - DNA, 731 bp, Zea mays
  misc_feature: Ceres CLONE 1413902-F
  misc_feature (499)..(499): n is a, c, t, g, unknown, or other
  misc_feature (502)..(502): n is a, c, t, g, unknown, or other
  misc_feature (534)..(534): n is a, c, t, g, unknown, or other
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaaaccttccgggaggtaatcttgcgccgattcggtgccgatttgcgccatccgcgaccggaggctccgccggtctttgtgtgcttgcgtcgaggtccctcaggacaacctggcctctgcttgattgcatacagggggttcagcgcctccggctcgtgatcttccctgacgctttcgtcgatcgctgatcaacctgcgcggacggtcctggctcctcttcacctcagtgctgctgccaccgtcgcgttagtcaagtcttgtgcaggataatagctatctcccgacagacgctataccgattcgagcattggctgcattcgtgaaggtagagatcccgctcgtgcttcatctcttgagctccagcatggtctgtactccaccgcctacccatactcagtgnagnatgtcgtgtgctcttcggtgtgcgcctcccgnaatccgtacccgaaagctactttggnccgctgaggcgatggcgacaagcacccacgagatggtcgagaccaagataaatctgacaggtccgctagctgggagcagcgaccgtatgtgccgcaaacgagatgatcttacgaactcgaatccactgtggtaccactcacatgactgggcaacgcatctcatcccaggtc

SEQ ID NO: 34943 - DNA, 706 bp, Zea mays
  misc_feature: Ceres CLONE 1413905-F
  misc_feature (204)..(204): n is a, c, t, g, unknown, or other
  misc_feature (205)..(205): n is a, c, t, g, unknown, or other
  misc_feature (208)..(208): n is a, c, t, g, unknown, or other
  misc_feature (217)..(217): n is a, c, t, g, unknown, or other
  misc_feature (293)..(293): n is a, c, t, g, unknown, or other
atagctggagctccccgcggtggcggccgctctagaatagtggatcccccgggctgcaggaattcgcacgagaccattacctagaaacttccttagctaacttcccagccccgacaccttggccgccgctccgtgcgcacccagttgctgaggttgcaacgctgcagccggcgaggatcggatgaaccaccaacccctcctatnnatnctaaccgangtctctgcttctgctctcatccatctgtagagtgcacatgcagtgccccatggacactgctgctagtggaactcgncagtgatgcatttcatagcaatgctgatgaggctatcgcccattcatctccattggaacatttaatacaacgtcacagggccttggtatgggggatggatccccagcggatttccccctggttggagcccctcattggtctcctgggctctcatcttggggactagggccgaaagatctcggccaactggagggtaaatggagatttttcgaaaaccggggaggtttggacagaattttgattggacttccggggattgggggatttgaaatgggccaaaaagggcccggtttaacccatgaccagagaatctgggggggctgaaaaaagggggggggaggtcttggaaaaatggtttggggaaattttggggaagggaaaaaaaggaggttccgggggttgtgcgggcaacc

SEQ ID NO: 34944 - DNA, 759 bp, Zea mays
  misc_feature: Ceres CLONE 1413909-F
  misc_feature: Encodes the peptide sequence at SEQ ID NO. 34945
  misc_feature (1)..(1): n is a, c, t, g, unknown, or other
  misc_feature (517)..(517): n is a, c, t, g, unknown, or other
  misc_feature (608)..(608): n is a, c, t, g, unknown, or other
nagagctggagctccccgcggtggcggccgctctagaactagtggatcccccgggctgcaggaattcgcacgagaccattacctagaacatcctaatcgaaaaaccatctctagaaccttcctcctcgcctccgtctttccctcccccagctcaggcaggaccgcaggagccagacccaaacccacgaaaccctcctgcctcgccgccgcttcctcatcctcccgccgcttagtcccggacccggaccaaccttcgtgaggacgggaattggactaagggggtaggatgccgccaaagaaagcggcgccatcgaaggcggagctggccaagaagcagaaggtcgtggaggacaagaccttcgggctgaagaacaagaataagagcaagaacgtccaaaagtacgtccagtccctggcaccaggccgtccagcccaagcctgactcgaccagaccgccgccaagaagaagaaggagggaggagaaggctcgcgagaaggagcttaatgatctggtccnaggttgccgtcagccagcccagggtcccctggttggtgttgatcccaagtcatatttgtgtgagttcttcaaggctggcaagtgccagaangggttttaagtgcaaattctctcatgacctgaatggtccagaggaagggtgaaaagattgatatctatacagaccagcgtgatgcaaaaaccatgggaggactgggatcaggaactccttggggaaggttgttggaatcaaaaagaaggaa

SEQ ID NO: 34945 - protein, 51 aa, Zea mays
  misc_feature: Ceres CLONE 1413909-F
MPPKKAAPSKAELAKKQKVVEDKTFGLKNKNKSKNVQKYVQSLAPGRPAQA

SEQ ID NO: 34946 - DNA, 734 bp, Zea mays
  misc_feature: Ceres CLONE 1413912-F
  misc_feature (269)..(269): n is a, c, t, g, unknown, or other
  misc_feature (280)..(280): n is a, c, t, g, unknown, or other
  misc_feature (281)..(281): n is a, c, t, g, unknown, or other
  misc_feature (284)..(284): n is a, c, t, g, unknown, or other
  misc_feature (285)..(285): n is a, c, t, g, unknown, or other
  misc_feature (290)..(290): n is a, c, t, g, unknown, or other
  misc_feature (291)..(291): n is a, c, t, g, unknown, or other
  misc_feature (298)..(298): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (309)..(309): n is a, c, t, g, unknown, or other
  misc_feature (311)..(311): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (325)..(325): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (331)..(331): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (411)..(411): n is a, c, t, g, unknown, or other
  misc_feature (412)..(412): n is a, c, t, g, unknown, or other
  misc_feature (422)..(422): n is a, c, t, g, unknown, or other
  misc_feature (431)..(431): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
aaaactggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcntctgtctgcgnncgnncgagnncagtgantgannnnttgngntggtccgatnnncngnnngnggnnntgnnnnnnnnnnnnnnnnnnnnnnnnnnnnnnnnnnnnnnnnnccccnnnnnnnnncccaaaagctggggagctnncacggagggntgggcgggncggcctcctaggaactagagggaatcccccgggggggcgtggaaggaaattccgcccgcggggacccctttttcccctagaaaaaatttcccttaatttggaaaaaaaaagggggggggtatttccccccaaaatggggggggcccccccctcccaaaaaaaagggggggggggtggtttttttttccccggggggggggggggggaatttttttccccccccaaaaaaaaaaaaataaaaaagggggggggggggggggggggggggccccccccccccnnnccccccccaccccaaaaaaa

SEQ ID NO: 34947 - DNA, 643 bp, Zea mays
  misc_feature: Ceres CLONE 1413915-F
  misc_feature: Encodes the peptide sequence at SEQ ID NO. 34948
  misc_feature (175)..(175): n is a, c, t, g, unknown, or other
  misc_feature (176)..(176): n is a, c, t, g, unknown, or other
  misc_feature (234)..(234): n is a, c, t, g, unknown, or other
  misc_feature (251)..(251): n is a, c, t, g, unknown, or other
  misc_feature (282)..(282): n is a, c, t, g, unknown, or other
aaagctggagctccccgcggtggcggccgctctagaatagtggatcccccgggctgcaggaattcgcacgagaccattacctagaacatcctaatcgaaaagtcgccagatctcccccagggacgcgctcatccttttgcctccccactgtgctgtgcaggaccctgcggggaanngcgtcgctcgctcgctgagagatgcctctggggctgacgctgggctcgctggggcggncgatgcgccggaagcgnttgccctcctcgacatctctcctccaggggnggcgcgggattactacaaggcaaagacttggagcccaccggtttccaccccgaaagggggtaattggatggtgatgaaaaagtgccacaatttggggccccggactggtgggttccggtgaagggaaaatggtccaagggcccggggccctcaagggggaaggttccccttctccccaaaaaaaattgaaaaaaaagttgttttttttttttttggggggggggggcccccccccggaggtgttttcccaaaagggcccggggggggggggagaaaacaccttttttttaacaaaaatttcaaaattttttttggggggggggaacaaatgggggaccccactacccttcccggcggggga

SEQ ID NO: 34948 - protein, 52 aa, Zea mays
  misc_feature: Ceres CLONE 1413915-F
  misc_feature (13)..(13): Xaa is any aa, unknown, or other
  misc_feature (29)..(29): Xaa is any aa, unknown, or other
MPLGLTLGSLGRXMRRKRLPSSTSLLQGXRGITTRQRLGAHRFPPRKGVIGW

SEQ ID NO: 34949 - DNA, 759 bp, Zea mays
  misc_feature: Ceres CLONE 1413916-F
  misc_feature: Encodes the peptide sequence at SEQ ID NO. 34950
  misc_feature (270)..(270): n is a, c, t, g, unknown, or other
  misc_feature (431)..(431): n is a, c, t, g, unknown, or other
  misc_feature (699)..(699): n is a, c, t, g, unknown, or other
catagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcggaaccgcggcgtggagccgcgnggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcgncgccgagctgggcagcctcagccgcgacgagctgtggcgccaggtgtggggggaagccacctaccgactcgccaccgtggtcgctttcctcgccgtcctcgcctttaccatctccgtctacttcatgtccagggcccaggcccgtggaactccatcgacttcgcatggcaaaaacccggccgacaagctcaaggtgcccagggcggggttcatcgacctggggcgcaagatcgggaaaggttaaagagaacagcccggcggttccagncggggctggttgccaaattccgggatatcgcaaaaaaccaacaggccgtgcttttagtct

SEQ ID NO: 34950 - protein, 39 aa, Zea mays
  misc_feature: Ceres CLONE 1413916-F
MSRAQARGTPSTSHGKNPADKLKVPRAGFIDLGRKIGKG

SEQ ID NO: 34951 - DNA, 752 bp, Zea mays
  misc_feature: Ceres CLONE 1413919-F
  misc_feature: Encodes the peptide sequence at SEQ ID NO. 34952
aagctggagctccccgcggtggcggccgctctattactagtggatcccccgggctgcaggaattcgcacgagaccattacctagaacatcctaatcgaaaagacgccgccccgttcgcctccgtcgccggcgccatcgccaccgccgaaccatggagaccacggagccgtcgggtggcaccaaccgccctctcaccgccactgcaggagatgacgacgatgctggcctggagcgcaagccgcggctccctaaggggaataaggccaagtaccgcgacgtcggtgcggagggaggtccctctggcaacgctgtgaaccacgacagcatgctgaatccatagattgcggagaagcggaggaaccatcatgacatggtacatgtcaaggaggaacacctcatcatgggaaatgaggctcaagcaacggtccatgaggtcttgaagcaggacattggttagtacagaggagagagatggtaataatcagccctcacctatgcgaaattcagacagagactggattggatattaaaaacctatggcagagaattaaattaatgcgcgccgaaataaattaggggagaatccgcttaacaaaaaccttacttaagttctttatggaggccacaaaactttcttagtggaacggtgataccttccacctttacacaaaagaatgggaccacatcaattatacgcatcccccagccgtcggggagcaagaaccaccctccagaatcagcatatcttgaac

SEQ ID NO: 34952 - protein, 62 aa, Zea mays
  misc_feature: Ceres CLONE 1413919-F
METTEPSGGTNRPLTATAGDDDDAGLERKPRLPKGNKAKYRDVGAEGGPSGNAVNHDSMLNP

SEQ ID NO: 34953 - DNA, 731 bp, Zea mays
  misc_feature: Ceres CLONE 1413921-F
  misc_feature: Encodes the peptide sequence at SEQ ID NO. 34954
  misc_feature (406)..(406): n is a, c, t, g, unknown, or other
  misc_feature (430)..(430): n is a, c, t, g, unknown, or other
  misc_feature (677)..(677): n is a, c, t, g, unknown, or other
  misc_feature (690)..(690): n is a, c, t, g, unknown, or other
  misc_feature (691)..(691): n is a, c, t, g, unknown, or other
  misc_feature (699)..(699): n is a, c, t, g, unknown, or other
  misc_feature (700)..(700): n is a, c, t, g, unknown, or other
aaagctggagctccccgcggtggcggccgctctagaactagtggatcccccgggctgcaggaattcgcacgagaccattacctagaacatcctaatcgaaaaccggcaccttccaaagttccaacttccaagtcacgagaaaggtttcgcttcgaaactcaaccggagatggcgagctctggcggaatctccgaccagctcttcgtctccgttaagttagagagcccgcacctcgcggagctcgacctcgccccccacctcttcggctcccaccctgtggctggctcgtgggacccctgcaaggccctgccctttggagcgggcggccaccgcccgtgtgggagttcagctgcgtcgtgccttcgcagcacgaatcgctggatttcaagtttgttttgaagcgaanaggtgataatcctcaatacattanttgaggagggacctaaccgaccattgggttgccagagaaatgaatttgagatgggggaatgcgttgtttaaactcaacgaaggggaaggaggtacttgagtgcaagggttcaggttgagacagaaatgttatccccaattgacttggcggctagttggagagctcatcaggagtattttcagccttcagggggtgcggggggactcacgatgtcactatcaaccctggggttaagaaggcagggccnagaatgggcttcnncttctggnnttggagcttgatttaaaccaagtatgtagtc

SEQ ID NO: 34954 - protein, 76 aa, Zea mays
  misc_feature: Ceres CLONE 1413921-F
MASSGGISDQLFVSVKLESPHLAELDLAPHLFGSHPVAGSWDPCKALPFGAGGHRPCGSSAASCLRSTNRWISSLF

SEQ ID NO: 34955 - DNA, 742 bp, Zea mays
  misc_feature: Ceres CLONE 1413926-F
  misc_feature: Translation starting site: 199
  misc_feature (420)..(420): n is a, c, t, g, unknown, or other
  misc_feature (594)..(594): n is a, c, t, g, unknown, or other
aaagctggagctccccgcggtggcggccgctctagaactagtgcatcccccgggctgcaggaattcgcacgagaccattacctagaacatcctaatcgaaaatccaaagtttcgtccaccatttggctcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggacttcgaggccgactttgaggtcttcgaggcagactccagtgattcagatttggagctcagggaggggactgacgacgancgtcgtcgagatcaagcccttcactgccaagaggactttctccagcgatggcttaagcaccaggactagtgctgtagcaaggtcagccaagaggaagagaaagaatctatacgggggtatccgccagaggccttggggcaagtgggctgctgagatcagagatctcagaagggngtccgtgtttggctggtactttcatagtcctgaggagctgcagagctatgatgctgaacgcgcaagatcgtgccaagaaggccaggtaactttctgaggcccagaagtggacagaagcgccttctgggtcgctccgctaaagctccaa

SEQ ID NO: 34956 - DNA, 771 bp, Zea mays
  misc_feature: Ceres CLONE 1413927-F
  misc_feature: Encodes the peptide sequence at SEQ ID NO. 34957
  misc_feature (718)..(718): n is a, c, t, g, unknown, or other
  misc_feature (761)..(761): n is a, c, t, g, unknown, or other
ggagctccccgcggtggcggccgctctataactagtggatcccccgggctgcaggaattcgcacgagaccattacctagaacatcctaatcgaaaaagatcgttccgtaagggcacccatcgtcatagatacgattcatagcttctgccactacttgtgcgcgaagagctcaagaaatgcgtcaggggttgtgaagggaaggagtgccgatggccggtggccacccggcgccgctgcggccggtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggatgctcaaccacctctcctacgccgtgctgtggcggatggctgagcgccaggtaaggctcggactgtctgtcgtcatcgattcaccgctgtcacgcccgctctcacctcgacatgctgacacgcctagccggtgtgcttgtggtcgtcctggagtggtcccttggtcatatcgaaggaatggcgcccgatgcctggataatcccgtgatccacactatatacacatagaggaataaactatatctggatgcatcaatacactttctacagcgtctccgctccccccccctgtacggcattcacacgtactcccacattcttgatttgtactncccccccccctcctacgtggcgtaccacactagcttattatanacacacattc

SEQ ID NO: 34957 - protein, 134 aa, Zea mays
  misc_feature: Ceres CLONE 1413927-F
MAGGHPAPLRPVVVAMKGHPGSGKSTAARAIATALCCPLLDKDDVRDCMLPLEGLAAAGMLNHLSYAVLWRMAERQVRLGLSVVIDSPLSRPLSPRHADTPSRCACGRPGVVPWSYRRNGARCLDNPVIHTIYT

SEQ ID NO: 34958 - DNA, 762 bp, Zea mays
  misc_feature: Ceres CLONE 1413935-F
ggagctccccgcggtggcggccgctctataactagtggatcccccgggctgcaggaattcgcacgagaccattacttagaacatcctaatcgaaaacaaagcctttcttcctcctgtgaagccaactcgtcccctcgggccaacgcgaggccaaaaccaatctcacatctcctccccctcccaccaccgaggacccttccccaagaactgctccgagtcctggagcgggagagaggtcgagggaggagcccaataagagtttctcctcgcctctctctctctctttcggctcgaaaaattattgacgaattggtgtggatcccttgccaaaaggaggctggttttctgtcctccctgaactaaagtgatggcgagcaccgcatcaaagaccgccgccgccgtccgcgtggtatttcggggcaacccgccaagtcgcgggagaacgatgggttgtggccgctcccggaaaggggggcctggccccagtaaggaaggctcctcccgggggggggggtgcccctgagaacccccggggtggaaggacccaggcccaaggcggtggggccaaggtcggaagaaaacccccggtggtcaaagaaaacttagaacctccggcagatagggtaccctggaagaaaaaggaccaacccgaaactgggcatagggtaccagggaaacccccccccaccagggggaaaaaggcacgaaaaactttgggggtgccaaaagaaatcacgtgccccggggtaatacaaaaaactg

SEQ ID NO: 34959 - DNA, 715 bp, Zea mays
  misc_feature: Ceres CLONE 1413937-F
  misc_feature: Encodes the peptide sequence at SEQ ID NO. 34960
  misc_feature (460)..(460): n is a, c, t, g, unknown, or other
  misc_feature (499)..(499): n is a, c, t, g, unknown, or other
  misc_feature (530)..(530): n is a, c, t, g, unknown, or other
  misc_feature (531)..(531): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagnaagcctctttcagttgaattgggacctggaattcttggnaacatttttgacggtatccagcgacctctannaacatcgctattaggtcaggagatgtgatattccccgggggggtttcagttcctgcccttgacaagatggattggtgggaattcagccacgagctaggggggtngagatgctcccccgggtggagatcatacgcctactgtttttgagaaccattgtgcagcacatgtgtccttccacgggttt

SEQ ID NO: 34960 - protein, 116 aa, Zea mays
  misc_feature: Ceres CLONE 1413937-F
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (84)..(84): Xaa is any aa, unknown, or other
  misc_feature (108)..(108): Xaa is any aa, unknown, or other
MAYGDRVTTFEDSENESEYGYVRKVSGPVVVADGMGGAAMYELVRVGHDNLIGEIIRLEGDSATIQVYEETAGLMVNDPVLRTXKPLSVELGPGILGNIFDGIQRPLXTSLLGQEM

SEQ ID NO: 34961 - DNA, 861 bp, Zea mays
  misc_feature: Ceres CLONE 1413939-F
ctagctggagctccccgcggtggcggccgctctagaactagtggatcccccgggctgcaagaattcgcacgagaccattacctacaacatccttatcgaaaaattgttcgcgtcgtccgccttctctctctctctaacccactgccagccacctctgcgaccgtcgcgaccactcgccaagtaaattttcttccgcccaactgactacgcctcgacctcggactcggcgccgcctccgaccgccggaaacggcagccatggcgcctgcggcggggatcacgcgctccgccactcaaccatcactcctgccgccgcacgaaacgcggatgactgagaacacacgacctgccctacaacaacccataaaaacccgccttgatacccagcgtcccagtaagatgcatgcgccccgcccttcaacgctctgtagacgatttccggcttccatgtagctaagaccaaccgccacctgcctcaccaacctaactttgccgcgcattccacgaagcacccccaatcgactacgaagccaagagtcataggacccaccccccccatcacatacaccatcgactcagggtttcatccaccccctctcaaactacccaacattcccaacaccgcactcagttacactaatggttcaataccatcaataaatccattacgcttatctcatcggtaatacattctacacatcacactcataccctaccgtcccttctcacacactcttctactgcccccacacaacaacccacacacaaccacccctcatacccagcctcaacgtcatcatccaaccataaacacactaagagcttctagcacgatccaccgtctacacataccatcctcaat

SEQ ID NO: 34962 - DNA, 741 bp, Zea mays
  misc_feature: Ceres CLONE 1413941-F
  misc_feature: Encodes the peptide sequence at SEQ ID NO. 34963
aaagctggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccacagggcgactaccacctccgcctccgcaagctcgtccagggcgcgctcggccccgacgcgctgcgcgcgctcgttcctgaggtggaggccgccgtgcggtcc

SEQ ID NO: 34963 - protein, 161 aa, Zea mays
  misc_feature: Ceres CLONE 1413941-F
  misc_feature: SWISSPROT Homolog: EC 1.14.13.93 (+)-abscisic acid 8'-hydroxylase
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHRATTTSASASSSRARSAPTRCARSFLRWRPPCG

SEQ ID NO: 34964 - DNA, 808 bp, Zea mays
  misc_feature: Ceres CLONE 1413949-F
  misc_feature (619)..(619): n is a, c, t, g, unknown, or other
  misc_feature (665)..(665): n is a, c, t, g, unknown, or other
  misc_feature (752)..(752): n is a, c, t, g, unknown, or other
  misc_feature (808)..(808): n is a, c, t, g, unknown, or other
caagctggagctccccgcggtggcggccgctctagaactagtggatcccccgggctgcaggaattcgcacgagaccattacctagaacatcctaatcgaaaaaaactagctgttaacctacctttcccctcccagccgtgggacgcaccaccctcagcctcccagctgccgcacacgtggaggctccacgcgaccacgcggcagcggcacgccggcacgcgcgccgcccggcgcccctcagcctcgcgccctcgccggccacgcgcctcagtcttgcgctctcgccgcgttaagccggtcagccttgcgggttgcggtctcgccgccgacgccgggcgtcgggattgccggctgcccgccttgccggagacgggagacgcccatgtccttggtgctcctggccgtctgtcagaaactcccgcggaccgcgccgttccctggtttgtccgaggacgtcggcaggaagcccctccgccgtcgcccggcaaaacgcgccaccgggggcggaccccttccccaagctccactggtcctggttcaacagctttccggtgccacccgggcggcgaaatcctactggccccatgtctgaccccaaaagttggaaaaagctctcccnggaaataatgggggggctcgagccttctctttggtgggggggcggnccggacctatggctgggaaccctcaaaatcacctcaggggcccgcgggaacattcccctgaaagatccgcgaaaggggaaggatggngccgggggtggctgtcccttatctcggaatagcacaaaaaaaagagcgaacttctn

SEQ ID NO: 34965 - DNA, 756 bp, Zea mays
  misc_feature: Ceres CLONE 1413950-F
  misc_feature: Encodes the peptide sequence at SEQ ID NO. 34966
  misc_feature (560)..(560): n is a, c, t, g, unknown, or other
  misc_feature (578)..(578): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (631)..(631): n is a, c, t, g, unknown, or other
  misc_feature (637)..(637): n is a, c, t, g, unknown, or other
  misc_feature (647)..(647): n is a, c, t, g, unknown, or other
  misc_feature (648)..(648): n is a, c, t, g, unknown, or other
  misc_feature (655)..(655): n is a, c, t, g, unknown, or other
  misc_feature (661)..(661): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (681)..(681): n is a, c, t, g, unknown, or other
  misc_feature (694)..(694): n is a, c, t, g, unknown, or other
  misc_feature (695)..(695): n is a, c, t, g, unknown, or other
  misc_feature (700)..(700): n is a, c, t, g, unknown, or other
  misc_feature (703)..(703): n is a, c, t, g, unknown, or other
  misc_feature (718)..(718): n is a, c, t, g, unknown, or other
  misc_feature (719)..(719): n is a, c, t, g, unknown, or other
  misc_feature (737)..(737): n is a, c, t, g, unknown, or other
  misc_feature (739)..(739): n is a, c, t, g, unknown, or other
  misc_feature (741)..(741): n is a, c, t, g, unknown, or other
  misc_feature (749)..(749): n is a, c, t, g, unknown, or other
  misc_feature (754)..(754): n is a, c, t, g, unknown, or other
ggagctccccgcggtggcggccgctctagaactagtggatcccccgggctgcaggaattcgcacgagaccattacctagaacatcctaatcgaaaaagatcgttccgtaagggcacccatcgtcatagatacgattcatagcttctgccactacttgtgcgcgaagagccaagaaatgcgtcaggggttgtgaagggaaggagtgccgatggccggtggccacccggcgccgctgcggcctgtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggatgctcaacgacctctcctacgccgtgctgtggcggatggctgagcgccaggtaaggctcggactgtctgtcgtcatcgattcaccgctgtcacgccgctctcacctcgacatgctgacacgcctagccggtgtgcttgtggtcgtcgtggagtgtcgccctggtgataacgagnaatggcgcccggagctgnagagccgtggtcgctggccacaagggggggggggggnnnnnantnnnannnanaataanaaaaaatttnnattttantaaaanaaannnnntatttannnaanttaaaaataaaannatatnttnaaaatttttttatannattaaatatttaaaaatnananatatttantttantt

SEQ ID NO: 34966 - protein, 148 aa, Zea mays
  misc_feature: Ceres CLONE 1413950-F
  misc_feature (118)..(118): Xaa is any aa, unknown, or other
  misc_feature (124)..(124): Xaa is any aa, unknown, or other
  misc_feature (136)..(136): Xaa is any aa, unknown, or other
  misc_feature (137)..(137): Xaa is any aa, unknown, or other
  misc_feature (138)..(138): Xaa is any aa, unknown, or other
  misc_feature (139)..(139): Xaa is any aa, unknown, or other
  misc_feature (140)..(140): Xaa is any aa, unknown, or other
  misc_feature (141)..(141): Xaa is any aa, unknown, or other
  misc_feature (143)..(143): Xaa is any aa, unknown, or other
  misc_feature (147)..(147): Xaa is any aa, unknown, or other
MAGGHPAPLRPVVVAMKGHPGSGKSTAARAIATALCCPLLDKDDVRDCMLPLEGLAAAGMLNDLSYAVLWRMAERQVRLGLSVVIDSPLSRRSHLDMLTRLAGVLVVVVECRPGDNEXWRPELXSRGRWPQGGGGXXXXXXNXKKFXF

SEQ ID NO: 34967 - DNA, 646 bp, Zea mays
  misc_feature: Ceres CLONE 1413952-F
aaagctggagctccccgcggtggcggccgctctataactagtggatcccccgggctgcaggaattcgcacgagaccattacctagaacatcctaatcgaaaactcctccattcctctccctctctctctcgtcggtgggaccgtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgggtccaattcggtgcctggctgactccgcacgttttccccccttttccctccctcgaccgacgaccgtccgtccaccaccggatccaggagcgaccctccctcgtgctcgtcgacgatcgaccggccgccgatcgtccaggaaggatgtcgagcctcgaggagccgctgggtctcggagacctgcccaggtgagtattacagactcgggcggttcgggtcgctgggcgctcggaggccaccggccgaagacgacgaccccagaactgggaaataagcaggaagctctggcaaaatggg

SEQ ID NO: 34968 - DNA, 721 bp, Zea mays
  misc_feature: Ceres CLONE 1413953-F
  misc_feature: Encodes the peptide sequence at SEQ ID NO. 34969
  misc_feature (538)..(538): n is a, c, t, g, unknown, or other
  misc_feature (539)..(539): n is a, c, t, g, unknown, or other
  misc_feature (584)..(584): n is a, c, t, g, unknown, or other
  misc_feature (602)..(602): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaaaaccggccggcttccctcgcccccggcgaggagtgaagacaagccgacaaggcaaaaccatcgcctgtacggtatccaaccgccgtcccgccgcacaaccaaggatagggcgggagagggggatctcgctttcgctccgctgccgcatgcgcaccgcccctcctcatgacaccaactagggcaccaccagcccccttctcgtcgacctccgcgcggtgactctgctgagcatcatacccttatagggcccgacccatggatgtaacttcgaccgctgccgcctccgcctcaggcgggggtaggtggtacacgggcatgtccgcggataacatcaagggcctggtgctcgcgctctcctccagcctcttcatcggcgccagcttcattatcaagaagaagggactcaagaaggccgcatcctccggcgtcagagcgnnggttggtggctattcttatttatatgagcctcttttggtgggtgncatgataaacatgattgntgnagaaagtgcaaatttcgcagcttatgcatttgcaccggctattttggtcactcctctcggtgctcttagcattattatcagccgtgggcttgcacatgaatgctggcggaaaactt

SEQ ID NO: 34969 - protein, 121 aa, Zea mays
  misc_feature: Ceres CLONE 1413953-F
  misc_feature (21)..(121): Pfam Name: DUF803 Pfam Description: Protein of unknown function (DUF803)
  misc_feature (61)..(61): Xaa is any aa, unknown, or other
  misc_feature (76)..(76): Xaa is any aa, unknown, or other
  misc_feature (82)..(82): Xaa is any aa, unknown, or other
  misc_feature (83)..(83): Xaa is any aa, unknown, or other
MDVTSTAAASASGGGRWYTGMSADNIKGLVLALSSSLFIGASFIIKKKGLKKAASSGVRAXVGGYSYLYEPLLVGXMINMIXXESANFAAYAFAPAILVTPLGALSIIISRGLAHECWRKT

SEQ ID NO: 34970 - DNA, 643 bp, Zea mays
  misc_feature: Ceres CLONE 1413958-F
  misc_feature (1)..(1): n is a, c, t, g, unknown, or other
  misc_feature (241)..(241): n is a, c, t, g, unknown, or other
  misc_feature (284)..(284): n is a, c, t, g, unknown, or other
  misc_feature (293)..(293): n is a, c, t, g, unknown, or other
nagagctggagctccccgcggtggcggccgctctataactagtggatcccccgggctgcaggaattcgcacgagaccattacctagaacatcctaatcaaaaaattgtccagccatcctcaggcagcttcgagttccacgacgagagcaccggcagccgcacacgcgtttgtctcctcgccggaccttcccggcaccgccgccggctctccctcacggtccactacactccacagcaccgncgtcgcacaacgacatgggctcctcccgctactatcttatggntcgcagggnccacgttcccctcggtcctctataagggcaacggcgaatggccttggcgggagaaccgccgcaacctcattactaagggcgaagaagccgtggccctctgttaataacccccctttgggccgggccggattgggcggcctgggttgggccctatattggaaaaaatctccctcccggggcctttgggggccgattttcctggttcgaggaaaaaggatttttaaaaaaaggcggggggggggaaaaaggtcgggctccaatttccgcaggacctgtgggggaacttttaaggctggggggacccccgggggtccaccttttgggaaatgggggggggaatctctgaataa

SEQ ID NO: 34971 - DNA, 738 bp, Zea mays
  misc_feature: Ceres CLONE 1413959-F
aaagctggagctccccgcggtggcggccgctctagaactagtggatcccccgggctgcaggaattcgcacgagaccattacctagaacatcctaatcgaaaacttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttggcaatggtcttaagaccagcgggaaaagagagagcctggtagtggccgaggtcagaaaacagatgtaccttgctgggccactcatcgctgcatggatcctacagaacattgtccagatgatatctatcatgtttgtcggtcaccttggtgagcttgccctctccagtgccctcatcgccacctccttttgcaggcgtactggcttcagcttattgtctggcatggcgagcagcttggacacactgtgtgggcaatcgttcggggcaaagagtactatcttcttggcatctaccagcagagggcaatccttgggtcactctaggcagccttgtgggtggaatattcgggcaaaacctggaaaaacctttcaccctttggccagaatcaaaaaatgcactggggaagggagttat

SEQ ID NO: 34972 - DNA, 760 bp, Zea mays
  misc_feature: Ceres CLONE 1413960-F
  misc_feature: Encodes the peptide sequence at SEQ ID NO. 34973
  misc_feature (445)..(445): n is a, c, t, g, unknown, or other
  misc_feature (760)..(760): n is a, c, t, g, unknown, or other
aaagctggagctccccgcggtggcggccgctctagaactagtggatcccccgggctgcaggaattcgcacgagaccattacctagaacatcctaaaaaaaaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggngctgctcatgtctgccgcgctccttcaaggcgcgtccgttggtccgctcgtcgaccttgttattgacttggattcgaggattctcgtcactgcgttcgtcgggaccgcagttgcttttgcaatgcttctctggcgctgccatcatcgccaagcgcagggaatacctgtacctcggcggtctgcttccatctggcctctccttctttctcggggtggcagttgctacctccaatctttgggcccaccagccgcaacctttaatgttggagcttcctcttgggccccctggttttttcctggaaaaaaatggtggtn

SEQ ID NO: 34973 - protein, 197 aa, Zea mays
  misc_feature: Ceres CLONE 1413960-F
  misc_feature (93)..(93): Xaa is any aa, unknown, or other
MESLFGQSQRRRRAGGSGFESLKRLGHISPAVQSHLKHVYLTLCSALAFSALGAYLHILLNVGGALTTVGCVASIAFLISLPASRDQERNRLXLLMSAALLQGASVGPLVDLVIDLDSRILVTAFVGTAVAFAMLLWRCHHRQAQGIPVPRRSASIWPLLLSRGGSCYLQSLGPPAATFNVGASSWAPWFFPGKKWW

SEQ ID NO: 34974 - DNA, 763 bp, Zea mays
  misc_feature: Ceres CLONE 1413961-F
  misc_feature: Encodes the peptide sequence at SEQ ID NO. 34975
caaagctggagctccccgcggtggcggccgctctagaactagtggatcccccgggctgcaggaattcgcacgagaccattacctagaacatcctaatcgaaaagccatcgccatttgcgatttctttcgaggaaaaagggaagcaagcgcggaaatactccacagataccactcacctaccgctccgatccggccaccaagcgcaaccaatatctcgctccctttctctttctccgtctccctcctccgcacagcgcacgcgcaggaggccgctgccgggaggcccatctctatctctctccgctggatcctccggcctctcgcggtccggtggagcggagatccggccgctcgggcgtcggctgcttcctcgttctgccggagcaagaagctggcatcccgccatgtcgtcaccgatgccctcccctactctgaaggaccatctctccacgcctacaggccccttgcatctcaaagtatgggaggtcatatgcattgccttgggagctttcatggtgctcgtcttgtttgccaccgtgtggctcacgctcaggagcaagaagagggtaaggcggcgggcatccgcaaatatcccaatcacccaaatcccctgcaatttccaaggaaatcaagggagtgagggtggaagcagtggccgggcagcgacttttgtggcgcatgatggcgtccctctcacgttcccaggacaagaacagcgaccgggattcggacaaggtcatggccccatttgggtggtagcaaa

SEQ ID NO: 34975 - protein, 119 aa, Zea mays
  misc_feature: Ceres CLONE 1413961-F
MSSPMPSPTLKDHLSTPTGPLHLKVWEVICIALGAFMVLVLFATVWLTLRSKKRVRRRASANIPITQIPCNFQGNQGSEGGSSGRAATFVAHDGVPLTFPGQEQRPGFGQGHGPIWVVA

SEQ ID NO: 34976 - DNA, 729 bp, Zea mays
  misc_feature: Ceres CLONE 1413962-F
  misc_feature: Encodes the peptide sequence at SEQ ID NO. 34977
  misc_feature (419)..(419): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
tggagctccccgcggtggcggccgctctagaactagtggatcccccgggctgcaggaattcgcacgagaccattacctagaacatcctaatcgaaaaacctcctatggccaccgtcgactgccccctgccctctcccgcggacctcgacgacaacggattcccggctctaccctcatcccccgctgcctgtagcagcggcttcgcggaggacttctaccgcagcggcaccgactggtcctccttacgcgcccctccgccgctggggccgcccagaaggcacccggtgtgaaggagagaggaggcggctcggccgtgcagagcagcctcttcccagcgtgggggatcgagaagccgcggcgggacgggcgtggggctgaatcatcgcttgtgcagaggagcctcctccaggcatgggggnatccaaagaccgaagagggagggtctccggggtggaaattcctccccccccctcctccctttccggtctttgtttggaaaggaaccggaggcaagaaaacaccgaggaaggaggggtggggggcaaagaaccccctcggggcccccttcaaaaaaaagatcctgggaccccatcacgtggagcatcgatgaaatgaggggcggcatctacctttatgcaagggtaaataacccnnnnnnnnnnnnnnnnnnnnnnnnnnnnnnnnnnannnnnnnnngnnnnnnnnnnnnnnnnnnnnnnnnnnnnnnnn

SEQ ID NO: 34977 - protein, 61 aa, Zea mays; identical to SEQ ID NO: 30670
  misc_feature: Ceres CLONE 1413962-F

SEQ ID NO: 34978 - DNA, 561 bp, Zea mays
  misc_feature: Ceres CLONE 1413964-F
  misc_feature: Encodes the peptide sequence at SEQ ID NO. 34979
  misc_feature (216)..(216): n is a, c, t, g, unknown, or other
  misc_feature (227)..(227): n is a, c, t, g, unknown, or other
  misc_feature (269)..(269): n is a, c, t, g, unknown, or other
  misc_feature (452)..(452): n is a, c, t, g, unknown, or other
  misc_feature (453)..(453): n is a, c, t, g, unknown, or other
  misc_feature (470)..(470): n is a, c, t, g, unknown, or other
aaagctggagctccccgcggtggcggccgctctagaactagtggatcccccgggctgcaggaattcgcacgagaccattacctagaacatcctaatcgaaaaatccgacccagtatccccgacaaagtcaatggcgatgcgtctcctccttgctctatcgactatcgtagccgattccccgttgcaagtaactaaaactaagtctcaagtctgcangaagtaacggnagtagcatagcactagcaagcaatggccggtctcactttcgnttctcttctttcgcggccctcctgggggggccgcccaagaaagggggtcccccttggctccactcccttccccggggggggcccccgtttccccccccgggaaaaaacccccttttccgggggggaggggaaaaacgcggggggccccacaaaaaaaccggggtgtcccccgggaaaaaaaanngcaaaaatacacccccnccccttttttttcccccccccccaaggttccccccgcccctcttcttttttttttttaaaaaaaaaaaaggggggtttccccccccccgcc

SEQ ID NO: 34979 - protein, 30 aa, Zea mays
  misc_feature: Ceres CLONE 1413964-F
  misc_feature (29)..(29): Xaa is any aa, unknown, or other
MAMRLLLALSTIVADSPLQVTKTKSQVCXK

SEQ ID NO: 34980 - DNA, 748 bp, Zea mays
  misc_feature: Ceres CLONE 1413975-F
  misc_feature: Encodes the peptide sequence at SEQ ID NO. 34981
  misc_feature (734)..(734): n is a, c, t, g, unknown, or other
caaagctggagctccccgcggtggcggccgctctagaactagtggatcccccgggctgcaggaattcgcacgagaccattacctagaacatcctaatcgaaaagctgccgttcccggcctaaacggaggcggccgtataaaggcattctcctcgcgccccacccggcggttatcttcaccaccatatcgacatcgacgccagcgagccaaggacagaacagccggcgcccggccctaaaactgccgtgcagcgggagagaagcgagggaaagatggaccggtaccagagagtggagaagcagagggaggaggcacccatcaaggaaaacgagatccgcattaccacgcaggggaggatgcgcaactacatcacctacgccaccggcttgcttcaggacaaaggttctgatgaggttgtattcaaggccatggggagggctatcaataagactgtcatggttgtggaattgatcaagaggaggattgttggcctccatcagaataccaccactggatctactgatattactgatatgtgggagccattggaggaaggcctacttccgcttgagacaacaggacatgcctttatgataactataactccttcaaagaaggagctggacacatcatctatcggatatcaatcccctttgcctgctgatgaagtgaaacctttggttaaatatgaaaatgacgaaaatgcaccctcccctgtgcccggaaaaaagatnccccgggggttcca

SEQ ID NO: 34981 - protein, 158 aa, Zea mays
  misc_feature: Ceres CLONE 1413975-F
  misc_feature (17)..(87): Pfam Name: Alba Pfam Description: Alba
  misc_feature: SWISSPROT Homolog: EC 3.1.26.5 Ribonuclease P
  misc_feature (154)..(154): Xaa is any aa, unknown, or other
MDRYQRVEKQREEAPIKENEIRITTQGRMRNYITYATGLLQDKGSDEVVFKAMGRAINKTVMVVELIKRRIVGLHQNTTTGSTDITDMWEPLEEGLLPLETTGHAFMITITPSKKELDTSSIGYQSPLPADEVKPLVKYENDENAPSPVPGKKXPRGF

SEQ ID NO: 34982 - DNA, 651 bp, Zea mays
  misc_feature: Ceres CLONE 1413977-F
  misc_feature (210)..(210): n is a, c, t, g, unknown, or other
aagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcngcgcagcgcaaccccagggcgcgttcgcatgcggtgcgtgggcggctcaggtcccacgtcacctcacgagcccgacaaacatcaggtcatcgaaaagtcgttgaggggcccgggaccaatacaaggagggatggcgcctgttccatgccccaaaaatgaatgggattccggtccaaggcagggaaaacccttgggaaatccggttgccctggaagaaagacccacacccctggggggttggggccctggaaaggggaaaattttctccaaggggccgggggggtcccaaaaaaacccaaaggggggttttttgtgggggggaacccccccccaaagggggccctttaaaccccggggagacccaaacatattgggggggggggggggcccccccgcgggggggggggggtaaaaaaaaaatatatttccccccgggggggg

SEQ ID NO: 34983 - DNA, 767 bp, Zea mays
  misc_feature: Ceres CLONE 1413980-F
  misc_feature: Encodes the peptide sequence at SEQ ID NO. 34984
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (454)..(454): n is a, c, t, g, unknown, or other
  misc_feature (482)..(482): n is a, c, t, g, unknown, or other
  misc_feature (483)..(483): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccggggttggcccggtgtgtgggggaacctggttccagtgatcctggcagcgacggccctttcattgtacgtgtgtggcgcgaccttccgggagnnnnnnnaaaaaagaacgggcngccccttttccacccatggggggatggnnggggggacgccctcattcgggccccccggggagtcttccccaagggtggtgaaaaagagccccatgtttccccaggccggccaaagaaagccccacccgcccctcctttaagggggggaaaagggaccggtaatttggggccccttaagacccccccgggggggggtttgggcccaattttttttttccaaaaaatgggtcccccaccggccagggtttttcccgcaaaacccggaaggggggggggggggagcccattttgcccccctccccgcccaatttcg

SEQ ID NO: 34984 - protein, 179 aa, Zea mays
  misc_feature: Ceres CLONE 1413980-F
  misc_feature (68)..(68): Xaa is any aa, unknown, or other
  misc_feature (69)..(69): Xaa is any aa, unknown, or other
  misc_feature (70)..(70): Xaa is any aa, unknown, or other
  misc_feature (75)..(75): Xaa is any aa, unknown, or other
  misc_feature (85)..(85): Xaa is any aa, unknown, or other
MDVNDVLLVVLAAALAAMWWRRCSKTGGVDGLPPGPPGLARCVGEPGSSDPGSDGPFIVRVWRDLPGXXXKKNGXPLFHPWGDGXGDALIRAPRGVFPKGGEKEPHVSPGRPKKAPPAPPLRGGKGTGNLGPLKTPPGGGLGPIFFFQKMGPPPARVFPAKPGRGGGGSPFCPPPRPIS

SEQ ID NO: 34985 - DNA, 627 bp, Zea mays
  misc_feature: Ceres CLONE 1413981-F
  misc_feature (627)..(627): n is a, c, t, g, unknown, or other
gctctagaactagtggatcccccgggctgcaggaattcgcacgagaccattacctagaacatcctaatcgaaaaaagagctcggtacatagccaagcaaacaggctgcaaacgctcacgaaaccacgcgtttggtggggtcggcgaggctggtgcggtggtgcacgccggtaactctcctcgccgtccaaagaagctataaattccacccaatcgccgccccgcacgcaccacaccgccccgaccatcaccgacaccagcgcctaagccccccccaaacggcaggagacagcagcaggccggaggtctcctccttctacgcatccactgagttccttcctgcgcaaagtaaatccccagttctttcggccgctgccaagttttcgagtgttgctagccccgccagagttttcttctcccccgcagtcgaattgggcgagaagttgatgggaccgggggcacactggaaggttgtgtgagatcgcgaaggggaccgtgaaatcctgagagggctgcggtgattcggctgctcggctgtatgaactgtttcgtgaacctgggactcaactccgaaatgaaccaatacggcgcctgcctccccatcttcccggggggatttctccccccn

SEQ ID NO: 34986 - DNA, 753 bp, Zea mays
  misc_feature: Ceres CLONE 1413995-F
  misc_feature: Encodes the peptide sequence at SEQ ID NO. 34987
  misc_feature (619)..(619): n is a, c, t, g, unknown, or other
  misc_feature (631)..(631): n is a, c, t, g, unknown, or other
  misc_feature (665)..(665): n is a, c, t, g, unknown, or other
  misc_feature (753)..(753): n is a, c, t, g, unknown, or other
caaagctggagctccccgcggtggcggccgctctagaactagtgcatcccccgggctgcaggaattcgcacgagaccattacctagaacatcctaatcgaaaatccaaagtttcgtccaccatttggctcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggacttcgaggccgactttgaggtcttcgaggcagactccagtgattcagatttggagctcagggaggggactgacgacgacgtcgtcgagatcaagcccttcactgccaagaggactttctccagcgatggcttaagcaccatgactagtgctgtagcaaggtcagccaagaggaagagaaagaatctatacaggggtatccgccagaagccttggggcaagtgggctgctgagatcagagatcctcagaagggtgtccgtgtttggcttggtactttncatagtcctgangaagctgcaagagcttatgatgctgaagcgcgcnagattcgtggcaagaagccaaggttaactttcctgatgcaccagaaagtgctcagaaagcgcgttctgggtcagcttccgctaaagcn

SEQ ID NO: 34987 - protein, 184 aa, Zea mays
  misc_feature: Ceres CLONE 1413995-F
  misc_feature (109)..(160): Pfam Name: AP2 Pfam Description: AP2 domain
  misc_feature (140)..(140): Xaa is any aa, unknown, or other
  misc_feature (144)..(144): Xaa is any aa, unknown, or other
  misc_feature (156)..(156): Xaa is any aa, unknown, or other
MCGGAILANLREPAPRRLTERDIWQQKKKLKRGGGGGRRSFAAEDDEDFEADFEVFEADSSDSDLELREGTDDDVVEIKPFTAKRTFSSDGLSTMTSAVARSAKRKRKNLYRGIRQKPWGKWAAEIRDPQKGVRVWLGTXHSPXEAARAYDAEARXIRGKKPRLTFLMHQKVLRKRVLGQLPLK

SEQ ID NO: 34988 - DNA, 703 bp, Zea mays
  misc_feature: Ceres CLONE 1413996-F
  misc_feature: Translation starting site: 166
  misc_feature (534)..(534): n is a, c, t, g, unknown, or other
  misc_feature (546)..(546): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaataccctctggcattggttgtcgatttcttcgttcgtgcttgcttgcgtaaaatatttaaataaatgaaggcaaatatgggcacaaaagctcgtccaccatctgctgatgcagaaaaaggggagattggcgaaatagatacaagggctccaattcaatctgttaaagctgcagtgagtttatttggtgaggtccgcttttcatctgacaaatcagctgaaagaaagcccaaggctcctcaaacagagagggttttagccaaggagacagagttgcacatggcccagaaagagttgaataaatacaaggaacagctcagtaatgctgagacaacgagagtacaggctctctctgagctagagaaagctaaaaaactgttgaggagctaacagccaagctggatctgattaacagtccaaacagttggccatccnagcaacagaggnatgcaagactcaaatcaagcagcttgaaggtggcagcacaagtgaaggtctaagaacagaatgtgctctgaagcaggaactggnaaagtgcagggagcagtatgctgttgctttgccaaaccttgatgcagaaaaacaagagcttaaaagctcaaga

SEQ ID NO: 34989 - DNA, 821 bp, Zea mays
  misc_feature: Ceres CLONE 1413997-F
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
tttttttnnnnnttttnnttcgcttacccccgttcgcgacctctcccaaaactggaactccccgcggtggcggccgcctctataactagtggatcccccgggctgcaggaattcgcacgagaccattacctacaacatcctaatcgaaaaaccctgtccctttccccgcgccaccgccctctccgtcgccgccgttcgaccgagcgccgctcacccaccccacgagctcccgcgcgggttcatgtccatctctccacacgaacgcaccggaggagcctattacccgcgcccgcacaaccctagccctagtccccaacatggcagtgacagacgccgccacggacgccgctcccatccggcatccatctcgacacccggcagccgctgcggaagctaggcgacggcgggggtcgggctcgaggctccaacccaggtggtctccaggctatttttaaaaatctacttaatgcttccccgaaaaaggctagttcggcagttaaataaacatctggggggaagcaagaatggtataacattgataacccccaaggaagggtttcgcgtaaatgttttttccaaaaatggcccaacttcctgtcaaaaaaccagagggggacaccccctcgggttctggccccgggcacaacacacttttcggccctccaatatgggagcccctcatccccctgaaaagaaccctcaaaacggtgccatggatccccctttaaaagaataaactaattttggagtttcaggcgttctaaacgggaacatggcttaactaggggaattccgtaaaacctggaccaagaaagataacc

SEQ ID NO: 34990 - DNA, 738 bp, Zea mays
  misc_feature: Ceres CLONE 1413998-F
  misc_feature: Encodes the peptide sequence at SEQ ID NO. 34991
aaagctggagctccccgcggtggcggccgctctagaactagtggatcccccgggctgcaggaattctcacgagaccattacctagaacatcctaatcgaaaaagggaagaaaatacaatcgctgaaaccagatgtccaacggatgactggaactcctgtcagtttgcactgagcaatggttcatccattctcaataaccacagtgctccacaggataacctcacttatggagataatgatctaaactacattgattggcctggtattgacaattttgaggatgttgacacattattcaggacatctgatttcacatatgatccgcagcagctggagaatacaaatgggttagtcttggcttccttcttcagatgctgtttactcttctgatgctgctttgcagcaaggccttgactcggcccattccgattatgacattctggatgatctctcagcattccaatgtgcagaagataaatcactaccctcagatggtccttcttcggatttatgtgataatcaattcaatgatacctatctgttcaccgaccacaagaatgcgaatgcatatggtgaacagatataccaggacgatgtgatggagttgttgcccactgaccacatatgaagtggacatgaaaacattgataatggtgcaaaccagtattcatctggaactacaatttaaaggtattgaaagacaaaaaattttcctatagcatcaacttctcaagttga

SEQ ID NO: 34991 - protein, 129 aa, Zea mays
  misc_feature: Ceres CLONE 1413998-F
KAGAPRGGGRSRTSGSPGLQEFSRDHYLEHPNRKREENTIAETRCPTDDWNSCQFALSNGSSILNNHSAPQDNLTYGDNDLNYIDWPGIDNFEDVDTLFRTSDFTYDPQQLENTNGLVLASFFRCCLLF

SEQ ID NO: 34992 - DNA, 688 bp, Zea mays
  misc_feature: Ceres CLONE 1414000-F
  misc_feature: Encodes the peptide sequence at SEQ ID NO. 34993
cgctcataactagtggatcccccgggctgcaggaattcgcacgagaccattacctagaacatcctaatcaaaaaacaactcccccaatccgtcccgtcggccggacgaggagggcccaagggcccaccttaccatggcgaccgccactgccgcccccgtccccgccggcggccacccgtaccgccgcgcccgcactcgctgcggcccaccgcgcctgcaccgcctgcgcttcccggccgcagcagcagccgcttcgtcttccctgcccgccccgtcgtccatgctgccaccgctgccaaatggaggcgggcggctggtggcggagctggtgtgcgcgttcaacgagctcacggagcggatgggggaggacctgtcgacgtcctcctcgtcaagcctgctcttccgggtggtgaagttggccctccccgcccttcgcaaaggggaaggcgggccgggaaacttcgacgggcggttcgccggcccccgggaccccccgttgacctccaaaggggtgggggaagcgttatccacccgggttaccaaaaaaaagccttttaatggcgggggccttaagaagggggggaaggaaaaaaccccaattggggataccgcaaaatcttttttttgggtgggggagcctttaagaattaaaaaaggggccccttccaaaactttggagctaatgtga

SEQ ID NO: 34993 - protein, 184 aa, Zea mays
  misc_feature: Ceres CLONE 1414000-F
MATATAAPVPAGGHPYRRARTRCGPPRLHRLRFPAAAAAASSSLPAPSSMLPPLPNGGGRLVAELVCAFNELTERMGEDLSTSSSSSLLFRVVKLALPALRKGEGGPGNFDGRFAGPRDPPLTSKGVGEALSTRVTKKKPFNGGGLKKGGKEKTPIGDTAKSFFWVGEPLRIKKGAPSKTLELM

SEQ ID NO: 34994 - DNA, 597 bp, Zea mays
  misc_feature: Ceres CLONE 1414001-F
  misc_feature (83)..(83): n is a, c, t, g, unknown, or other
  misc_feature (110)..(110): n is a, c, t, g, unknown, or other
  misc_feature (111)..(111): n is a, c, t, g, unknown, or other
  misc_feature (132)..(132): n is a, c, t, g, unknown, or other
  misc_feature (146)..(146): n is a, c, t, g, unknown, or other
  misc_feature (394)..(394): n is a, c, t, g, unknown, or other
aaagtggagctccccgcggtggcggccgctctataactagtggatcccccgggctgcaggaattcgcacgagaccattacctnagaacatcctaatcgaaaaagtgccannccactcgccagctcgccactntcctcccgtctccntcccttgcagaggcggcgcgtaaaccccgatggccgcctctctcctccacgccgccgccgccgccgcctcgctcctgagctccacccagcacgcccgcgcggggtgccgccgcctttcaccccctcgcgtgtgccccatccctacgccttacgcgctcctcgttctcgaccaatcgccacctcgagatttcactccggggcgatctcgccagtcgcccgtttccgcggggagggggggcacccccggnaccgccgcgttgtcgcccgccctaacgggggaagcaacacgaggggttcaagggggggggatgaccgaaaacggggaaaataaagcccgagggaagttccggaaatttggaaaggaatggctggaaacattcaagggttgagggcccttggggaggaggcccctgaaaaaggggggtttttggtgggtttccccccaaaggga

SEQ ID NO: 34995 - DNA, 777 bp, Zea mays
  misc_feature: Ceres CLONE 1414002-F
  misc_feature: Encodes the peptide sequence at SEQ ID NO. 34996
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttttttttctcctttnnntnntcctttnnnnntaattgataannntacttctaccacaaaactggagctcaccggggtggcgtgtctctctataactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgttgcacagaggtcttccggaggcttgtgcacctggcttgactggtgcgcgttcaaatgaaatacctcctccagatttcacaccttttccgggagtgactattcctccctccgctgcctagaacaatggtgaaggttggacaaaacaagaattcaacaacactttccccaatggtcgttaaaataaccctcctgagaccatctgcgggcatcatctttgccccggttgcaagctcaatggtcgaatcgggctatccggaattatgaaagcaccctgaaataacacggtggaaagtatacttctggaagaaaaggggcctttacaaccactggcacacagaatggtttggatgtgccccaatttcccaacaggggagccc

SEQ ID NO: 34996 - protein, 50 aa, Zea mays
  misc_feature: Ceres CLONE 1414002-F
MYRVASGLGALKRHGANAQMMNAAIRCASTSVAQRSSGGLCTWLDWCAFK

SEQ ID NO: 34997 - DNA, 719 bp, Zea mays
  misc_feature: Ceres CLONE 1414005-F
aaagctggagctccccgcggtggcggccgctctagaactagtggatcccccgggctgcaggaattcgcactaaacctttacctataacctcctaatccaaaacccctcgtctcgtcgccgcctactaaaatggctgcgctcgcgacactcctccgccacagccgccgcacccatgtccacgtcctccccatcaccggtgctctctccaccaccaccccaaccaccggcgtgaccgattccgaatgccatcacgtgacatcacgccaagagacaactcgcacggcgagcagctcatgcgaactgactggccactctcctccacgccaggcgacacgcggactatcgtcctctgcttccacccgacacgcgcatctccctcaccgcgcggcccctttcatcccttcctgcccttccgtgacacgaagggcctcgtctcttcccatatcgccgcggtcgccaccgaggacccaccagctccgctgacgctgtgctagtacgtcttccgccaaccatcatgacgaacgccactgcacgctgtaccgctccggctggtgacgtcccatgtgtaatggaccacctccccgcatccgccttccgaagagcctactcctccaatgttcagtagcccggccgccgcctacgaacaaccccccgtagtactacttccgctggagcctcttcccggggaggtttttccattcacaccccccgttgccggc

SEQ ID NO: 34998 - DNA, 712 bp, Zea mays
  misc_feature: Ceres CLONE 1414009-F
  misc_feature: Encodes the peptide sequence at SEQ ID NO. 34999
  misc_feature (337)..(337): n is a, c, t, g, unknown, or other
  misc_feature (345)..(345): n is a, c, t, g, unknown, or other
  misc_feature (346)..(346): n is a, c, t, g, unknown, or other
  misc_feature (351)..(351): n is a, c, t, g, unknown, or other
  misc_feature (354)..(354): n is a, c, t, g, unknown, or other
  misc_feature (367)..(367): n is a, c, t, g, unknown, or other
  misc_feature (369)..(369): n is a, c, t, g, unknown, or other
  misc_feature (371)..(371): n is a, c, t, g, unknown, or other
  misc_feature (461)..(461): n is a, c, t, g, unknown, or other
  misc_feature (581)..(581): n is a, c, t, g, unknown, or other
aaagctggagctccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactagccgccatggcgtcgtcgtgcatcccggccggcggcatccggctgccggacctggagatggtcaaggncgcgccgnncgcgncgncgccccgcccggngnantcagcggcgtcctccacgctctcggaggggtccaactcgtccccagcctcctcgtcgtcgttggcgtcgctgtcgctcaagcgcccgccnaccgccgggaagcgggccagccagacgtacacgaagggggggggctgctcccggtcatgtacccctcccggatcccccgtcccaggggttgggggggcccccaaggggggcccccccgcntctctgggtttccctccccgtttgtgggaaaacccttttttgccaaaattcccccctcctttcccctttccgggggggaacccctttttttttcctcaaaaattggccccccccccaaaaagcccccccgg

SEQ ID NO: 34999 - protein, 145 aa, Zea mays
  misc_feature: Ceres CLONE 1414009-F
  misc_feature (21)..(21): Xaa is any aa, unknown, or other
  misc_feature (24)..(24): Xaa is any aa, unknown, or other
  misc_feature (26)..(26): Xaa is any aa, unknown, or other
  misc_feature (27)..(27): Xaa is any aa, unknown, or other
  misc_feature (31)..(31): Xaa is any aa, unknown, or other
  misc_feature (32)..(32): Xaa is any aa, unknown, or other
MASSCIPAGGIRLPDLEMVKXAPXAXXPRPXXSAASSTLSEGSNSSPASSSSLASLSLKRPPTAGKRASQTYTKGGGCSRSCTPPGSPVPGVGGAPKGGPPASLGFPPRLWENPFLPKFPPPFPFPGGNPFFFPQKLAPPPKSPP

SEQ ID NO: 35000 - DNA, 738 bp, Zea mays
  misc_feature: Ceres CLONE 1414011-F
  misc_feature (12)..(12): n is a, c, t, g, unknown, or other
  misc_feature (19)..(19): n is a, c, t, g, unknown, or other
  misc_feature (21)..(21): n is a, c, t, g, unknown, or other
  misc_feature (738)..(738): n is a, c, t, g, unknown, or other
tttttgttcctncctcccncntctctccttcccttcctcgcctttttactttttccaaactggagctccaccgcggtgagcggccgctctagacactagtggatcccccgggctgcaggaattcgcacgagaccattacctagaacatcctaatcaaaaaactctcgctttcttctgtctcgcctcgccctcgcctttgttgatcttttcctttctcgcgttcccctcgccttcctcttcctcccccacacccaccggtcgccgcccccgtcgccccggcctcctcggtccagagacgagggggtccgcgccgttccgacgccacaccgcaaccgcatcacatcaccgcctgctcccaccgtccatccgccctccctcgatcgcgctccccggatcgctggtacctccgcgcgcggctccgacctcatcttcctccatcgactggcatcggcagcggcggcgtgttcccggccaaccttcgaaagggtaatcaatcgccagactcgtgcgagctgtgttgggcgggaccgggggcaagagccaagtgactgcagaggctaacatttccggttgtcgagtgatggcgcaaggaatcaacttccctgacttcatccgggaccgcgggatggcccatgaagggggccgtgaacctttgccgcgccaccttctggcgatatgggccttcttacccagacagcgtaggggggagggggacccaacatttgtccggcacgaacn

SEQ ID NO: 35001 - DNA, 722 bp, Zea mays
  misc_feature: Ceres CLONE 1414012-F
  misc_feature: Encodes the peptide sequence at SEQ ID NO. 35002
aagctggagctccccgcggtggcggccgctctagaactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactggccggacagggcggggcgcgccaccacggatggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccggcgtccctgggcccgcgcgaggcccgcgcgctccgggaccgcctcgcgggggagctcacccaggtgcgcggcctcctctcccgcatcgacacctggcagcagcagggcccgccgcccgcggtagctccgcgccgaggtgcggaagcggtgtgggcagatcctcaccatgctgcgcaaggacaagcgtagcgtgtgggtcaacgcagccgacgaggtggagcgtctcggtctccacgactaccacgccgtcatcaagcggcccatggacctcggcaccgtcaaggagggcctcgccgccgggaggtacgct

SEQ ID NO: 35002 - protein, 48 aa, Zea mays
  misc_feature: Ceres CLONE 1414012-F
MLRKDKRSVWVNAADEVERLGLHDYHAVIKRPMDLGTVKEGLAAGRYA

SEQ ID NO: 35003 - DNA, 585 bp, Zea mays
  misc_feature: Ceres CLONE 1414016-F
  misc_feature: Encodes the peptide sequence at SEQ ID NO. 35004
aaagctggagctccccgcggtggcggccgctctagaactagtggatcccccgggctgcaggaattcgcacgagaccattacctagaacatcctaatcaaaaaaggtcgagcctagggttagggtttcgtccctccggccccgattcgaaccaatccgcctcggcctccgccgcgccatggccgccggctccatcgtggtggacttcccttcatgggcgcgccctctgcttcccagcctcgattcactcctccgcgactcgcctcgggcttctcgctgcgtctcaacgccccagccccggcgcagccgacctcaccaactttcaccgcgtcttctcgcgcgtcctcagggcctacccggacccaacggtcgaggctgtctggtttcttctcccggggtttcctttccaagaccggtcccaaagaacctcccggtcccctgggttccaagttccctttcccgcgcttttaaccgccccctccttccccggaaacccccccaaaagggcgtttggccctttttcccccccccggggtttttttcagaattttttcccccccccaaaaaaaacccccggggggaaacac

SEQ ID NO: 35004 - protein, 195 aa, Zea mays
  misc_feature: Ceres CLONE 1414016-F
KAGAPRGGGRSRTSGSPGLQEFARDHYLEHPNQKRSSLGLGFRPSGPDSNQSASASAAPWPPAPSWWTSLHGRALCFPASIHSSATRLGLLAASQRPSPGAADLTNFHRVFSRVLRAYPDPTVEAVWFLLPGFPFQDRSQRTSRSPGFQVPFPALLTAPSFPGNPPKRAFGPFSPPRGFFQNFFPPPKKTPGGKH

SEQ ID NO: 35005 - DNA, 713 bp, Zea mays
  misc_feature: Ceres CLONE 1414021-F
aaagctggagctccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaatcttggtgagttctgttcatgtgcatttgagcttacgcatctatgatacgcgccttagggattgtgatctgtgattaggggttgtgaaattgagatgccattttagggattgtggaagtgtgaactgtgccttactgaaatcgagatgccatttgagcaagttttcaactattttgttggattggcgaggttatgagaccttttcagatactttatatccgaattgttggaaaatata

SEQ ID NO: 35006 - DNA, 785 bp, Zea mays
  misc_feature: Ceres CLONE 1414022-F
  misc_feature: Translation starting site: 254
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (31)..(31): n is a, c, t, g, unknown, or other
gggcccccccnnnnnnnnnnnntctttctcntccttctgccaagtttgtggcaaagtggagctccaccgcggtggcggccgctctagaactagtggatcccccgggctgcaggaattcgcacgagaccattacctagaacatcctaatcgaaaactctcgagtcggaaaaccctcgaaccctagccgggatccgacaacgcctccatcgctagtcgcctcctgcaagtttgtgagctcaagagtcgtggcgtcatggggacagagacggagactttcgcctttcaggctgagatcaaccagatggtctcactcatgagcaataccttctattaccagaaggagatctctcctccgggagctcatttccaactcttccgatgcgctggccacaaccacgtgcgagagcctgactgacaagagcaagctcgatgcggaaccgtagctgttcatccacattgtacccccccagggttgcaaacctcctctccatcatccacacgcggcttaggtattgacccaaaccagaccccgacccgcaacctcggtccaaatcgcctaggttcggcgcccaaggcagcccctcggaagccccttgcttgctgggggcacgatgtgtcctatgaagtgggtctcgttccggtgtacccgaataccatcttcgcgccaacccccgacggacgacgaggggactggtattgggccggccaagagaaaaaacgaagcgaacgaatcacataccacgatcggggaaccgcacagacgcggggaggaaaagtcggtactc

SEQ ID NO: 35007 - DNA, 747 bp, Zea mays
  misc_feature: Ceres CLONE 1414023-F
  misc_feature: Encodes the peptide sequence at SEQ ID NO. 35008
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (747)..(747): n is a, c, t, g, unknown, or other
ttttccccctttcctcccctnnnattattatcataatgctaaccccgaggaacaaaactgcgactccaccgcggtggcggccgctctagaactagtggatcccccgggctgcaggaattcgcacgagaccattacctagaacatcctaatcgaaaaatcttcaaaaactacccacggcccgtctcctcgacctccccgaaaccccacttctcggatcgagactagggttagggtttcgtcactcccgccccgattcgaaccaatccgcctaggcccccgccgcgccatggccgccggttccattgtggtggacttcccctccatgggcgccgccctctgcttccccaacctcgaatcactcctccgagactccgcctcgggtttcctctccgccgtctccgccgccccggcccccggcgccgccgacctcaccaacttccaccgcgtcttctcgcgcgtcctcagcacctactcagacccgccgctcgaggtcgtctggttcttctccgcgctctccttccacgaccgccctgacgacctccgctcactgatccagctcctctccgccttcgccgcttcctcgcctggggccgccaagccgctcgccctcctcgcccccgtcggctccgagcttttcccctcagaaaaggccgggcagggaaaaccgagggccgccgtcggaggcttgttcgtaagctaaattcagcaatctggcagaaaggtcgacccgcggcccccatcttacan

SEQ ID NO: 35008 - protein, 137 aa, Zea mays
  misc_feature: Ceres CLONE 1414023-F
MAAGSIVVDFPSMGAALCFPNLESLLRDSASGFLSAVSAAPAPGAADLTNFHRVFSRVLSTYSDPPLEVVWFFSALSFHDRPDDLRSLIQLLSAFAASSPGAAKPLALLAPVGSELFPSEKAGQGKPRAAVGGLFVS

SEQ ID NO: 35009 - DNA, 666 bp, Zea mays
  misc_feature: Ceres CLONE 1414025-F
  misc_feature: Encodes the peptide sequence at SEQ ID NO. 35010
  misc_feature (357)..(357): n is a, c, t, g, unknown, or other
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaaagacgggggcgtttctcgatctgacgctcgcctgggcctgcctctgcctcgccgcgctcgccgccgccgccgcgcgcctcctcgcgctcctcggcctcccgctcccctgcacctgtgcgcgcccgcacctgccctgcctcctcgccttcctggtgcgctaccctccccgcgccgtcggatcccttcacgccgccctccgcgcccgcttccccttcgccggccccaccgacgacgaggcacgccttcagaaaaggggntgggaggaagagggggaggaggaggccatctgatatgtgcggaaggaggaaggggattttcgtcgccgcgtggaggcgcgcgccgagctgcagatggagctcgagaaagagcgcagcgcccgcggcgtcggcggccgaggaagccatggtcatgatcctgcgcctgcagaaggagaaagtcgcgcttgagattgangcgcgacagcagcgccgaaacgctgacgagcgctgcgccttctaacaagacgaggtccaagagctccgggaaatccggctcctgcgcgaaccggaggtggccccggttcccaa

SEQ ID NO: 35010 - protein, 68 aa, Zea mays
  misc_feature: Ceres CLONE 1414025-F
  misc_feature (54)..(54): Xaa is any aa, unknown, or other
MCGRRKGIFVAAWRRAPSCRWSSRKSAAPAASAAEEAMVMILRLQKEKVALEIXARQQRRNADERCAF

SEQ ID NO: 35011 - DNA, 690 bp, Zea mays
  misc_feature: Ceres CLONE 1414033-F
  misc_feature: Encodes the peptide sequence at SEQ ID NO. 35012
  misc_feature (423)..(423): n is a, c, t, g, unknown, or other
  misc_feature (460)..(460): n is a, c, t, g, unknown, or other
  misc_feature (472)..(472): n is a, c, t, g, unknown, or other
  misc_feature (517)..(517): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaaaaagacgagatctacccgctgccccctcgcattcccctcccccgcgtcgtcatctccccaaatccccccaaaccctaccgccgatccggccccagatcgccatggccgcgcccaacagcaatgacgccgccagcgccagcggcaccggcccggctggcgaggaggacatctccatcgaggcgttggcgcggcgcgtgcaagagcacatgaccctcaactcgaaccccgccgctcgccgccacaagttctgagagacacagcccgtcggccagttccgcgacgccgccgacgcatcgctaccgaacggccccatcgagccgnccacgccactctccgagggtgcgcgcgacccctaccnactggcccgcgncttcgagtggctcacctgcgacctcgatgacgacgcgctcctcgnncgactctactcggtgctcgcccacaactacgtcgggggatgaccagaaactggttccgcttaacttattccccggcctttcttcggttgggggttcaggccgcggtcttttttccggggctgggaaatcggggtttcggccaaagaaacccaaaaaatccgcccctttcttt

SEQ ID NO: 35012 - protein, 49 aa, Zea mays
  misc_feature: Ceres CLONE 1414033-F
MAAPNSNDAASASGTGPAGEEDISIEALARRVQEHMTLNSNPAARRHKF

SEQ ID NO: 35013 - DNA, 684 bp, Zea mays
  misc_feature: Ceres CLONE 1414039-F
  misc_feature: Encodes the peptide sequence at SEQ ID NO. 35014
  misc_feature (684)..(684): n is a, c, t, g, unknown, or other
aaagctggagctcaccgcggtggcggccgctctataactagtggatcccccgggctgcaggaattcgcacgagaccattacctagaacatcctaatcaaaaaaattgcgacgccgccgtcgccactgtcgccgcaagagtggaaaccacgctgccgcccgctcccggcgcccgaaacagttttatccgattccctattcgccggatgacatgttgcgggcacctctcaaatgacctctcaactccagagcactttgatcctgctcccgatcttcgccgccgctgcttagggccgcggaggggacgcctccacttgcgacgcctctgtagctccaccatctgttctccgcaccgctgcggctcagtatgcaggcccaaggatcgcgcgctccatggctgactggccgtctcccggcagcgccagatacgatcgacgcccttgcagagaaatatagccaccggaaggcgactgccacacgcgatagaagtagcgacacaccaacgctcactttagcggagggaaatgccaccctcaagcgcagcaacctcggattgtagaactatgctcttgcgaccattgcaacactgtgtgcagacgttcatgttgccttctgtgacacaggcacgcgatctcttctggctgtctcgtcagtgcgacttgtgcaagcctccagctactgctgcn

SEQ ID NO: 35014 - protein, 63 aa, Zea mays
  misc_feature: Ceres CLONE 1414039-F
MQAQGSRAPWLTGRLPAAPDTIDALAEKYSHRKATATRDRSSDTPTLTLAEGNATLKRSNLGL

SEQ ID NO: 35015 - DNA, 667 bp, Zea mays
  misc_feature: Ceres CLONE 1414041-F
  misc_feature: Encodes the peptide sequence at SEQ ID NO. 35016
aaagctggagctccccgcggtggcggccgctctagaactagtggatcccccgggctgcaggaattcgcacgagaccattacctagaacatcctaaaaaaagaacaaccaccagctctctcccccgtctatctcttcttggagcctggagaagaggaaggatcagggaacgggggaagaggttgctgccacagctcaggtctcaagtttggattcagacaagtagacaaacaccagttggttaagatggcagctggtttccagatcggtgtgatcgggtcacttgcactctctgttgcatcttcagtttccattgtcctctgcaacaaagctctcatcagcacacttggttttccattcgctacaacattaacaagctggcatctgatggtgaccttctgcaccctccatgtggcacagcgcttacgtttcttcgagcccaaggcaattgatggacagacagtcatactctttgggttgctgaatggcacgtcaattggtcttctcaatctgagtttaggattcaactccattggattctaccagatgacaaaattggcgatcatacctttcactgtgctattggagactatctttctgaaagaaagattcaggagaaacatcaagtttcagatatttccaaataaactcttggatcaactgattgat

SEQ ID NO: 35016 - protein, 141 aa, Zea mays
  misc_feature: Ceres CLONE 1414041-F
MAAGFQIGVIGSLALSVASSVSIVLCNKALISTLGFPFATTLTSWHLMVTFCTLHVAQRLRFFEPKAIDGQTVILFGLLNGTSIGLLNLSLGFNSIGFYQMTKLAIIPFTVLLETIFLKERFRRNIKFQIFPNKLLDQLID

SEQ ID NO: 35017 - DNA, 676 bp, Zea mays
  misc_feature: Ceres CLONE 1414042-F
  misc_feature: Encodes the peptide sequence at SEQ ID NO. 35018
  misc_feature (676)..(676): n is a, c, t, g, unknown, or other
agagctggagctcaccgcggtggcggccgctctatactagtggatcccccgggctgcaggaattcgcacgagaccattacctagaacatcctaatcgaaaaaacccggcgaaagccccccaaaccctcgcaccctaaaacagcggcgcacaagatgtccgacgaccccaccaacggcgtgcggtggtgatcgcgtggaggacgtcgtccgcaccgagggtgaaacacaacctcgtgatgatgggttgccgaaatccaaggatagggacaaagatagagaaaaggacaaggacagagatcgtcgcaaagaccgtgacagagatcgagggagagacagggaccgtgatagggacagggacagttatcgggacagagacaaggatcggcaaagtaggcatcaccgtgaaagacggtaacagcgagaccgtcctgatgatcacagagtccgtgattctgaaagaataagagaacgcgacaaagatgggcatcgtaggcatcgttctcagtctcgttcaaggggtagagatcgaagatctaggtcacgttcaagaagcaagcgagttagtggattctatgcgccacccccgcaagcaatgggttcaacatttccagttattccaaccccaagtcagttaccaggctcttcgcttcataacattggtggcatgtttccaaan

SEQ ID NO: 35018 - protein, 75 aa, Zea mays
  misc_feature: Ceres CLONE 1414042-F
MMGCRNPRIGTKIEKRTRTEIVAKTVTEIEGETGTVIGTGTVIGTETRIGKVGITVKDGNSETVLMITESVILKE

SEQ ID NO: 35019 - DNA, 664 bp, Zea mays
  misc_feature: Ceres CLONE 1414049-F
  misc_feature: Encodes the peptide sequence at SEQ ID NO. 35020
aagctggagctccccgcggtggcggccgctctatacactagtggatcccccgggctgcaggaattcgcacgagaccattacctagaacatcctaatcgaaaaacccccacacccccgtctccctcgctcgcctcgcgcggagtgttgcctttccgtgtggtctcttctcgccccaggcttctccacccgcccaccccaacatccacacctccttcgctcgcccgctccttctctcctcccctcccctccgctccccacccagaagagcgcgcgcggcgacccggacccagtcaggcggactcccatcccctcctccccaagcgagccgagctgcgagcgctgctcgcgcggtcgatccatggcgagcggcggcgtcggagacctgggtgcggctgacgcgacaggccctatgcccacgtggagggagcgcgagaacaacaagcgccgggagcgccgtcgtcgagcgatcgccgccaagatcttcgacggcctccgcgcgaacggtggttacaagctgcccaagcactgcgacaacaacgaggtgctcacggcgctctgcaacgaggccggatgagtcgtcgagcccgactgcaccacctaccgccagggaagcaagcccatgaaacgcatggatcccatcgggtgctccgagtcaccaagtcta

SEQ ID NO: 35020 - protein, 71 aa, Zea mays
  misc_feature: Ceres CLONE 1414049-F
  misc_feature (13)..(72): Pfam Name: DUF822 Pfam Description: Plant protein of unknown function (DUF822)
MASGGVGDLGAADATGPMPTWRERENNKRRERRRRAIAAKIFDGLRANGGYKLPKHCDNNEVLTALCNEAG

SEQ ID NO: 35021 - DNA, 683 bp, Zea mays
  misc_feature: Ceres CLONE 1414053-F
  misc_feature: Translation starting site: 218
  misc_feature: SWISSPROT Homolog: EC 4.1.2.10 Mandelonitrile lyase
  misc_feature (580)..(580): n is a, c, t, g, unknown, or other
  misc_feature (581)..(581): n is a, c, t, g, unknown, or other
  misc_feature (625)..(625): n is a, c, t, g, unknown, or other
  misc_feature (658)..(658): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggcagctgcatcaacgccggcttctacacgcgggccagcgacgactacgtgcgnngcgtcgggtgggacctgggcgccgccggggcggcgtacggtggntggaggacgtggtgccgtccagcgatggggggnnccccctggaaggccgggcttgaag

SEQ ID NO: 35022 - DNA, 711 bp, Zea mays
  misc_feature: Ceres CLONE 1414054-F
  misc_feature: Encodes the peptide sequence at SEQ ID NO. 35023
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
aaagctggagctccccgcggtggcggccgctctatacactagtggatcccccgggctgcaggaattcgcacgagaccattacctagaacatcctaatcgaaaaattttttctcgcgcttcgctctcacgctcgcgtcaccggagctctccagaaccgaaccccaactgaccaagggcgagcgatccgaacccctcggcggcttcgtcaacgacgcccagaacactttgaggaatgtctgaagaggatgtccagccccttgagtgtgacaatgccactgcgatgcgtcaggcgtctttcgctgttgacgacgcaccgagagctgtcttccctagcattgtagggagggcaccccacactggtgtgatgnnnggggctatgggcaaaagggagaaattggggcgaagaaactccgtccaaaaaggatttcggacctggatacccattggaacagggttggcggaaatggggaggccatgggaaaaaatgggcccccccccttaaaaaagggttttctgggggcccgggggggccctttttggggggggggggggcctcttggccccccggggaaagggggaaaaaaaccccccaattttggggcagacactcccccccccccaagtggggggccccccggggggttttttttcttcggagggggggaaaaaaaagagtttttggtttttctgtgggtgggggccgcccccccc

SEQ ID NO: 35023 - protein, 89 aa, Zea mays
  misc_feature: Ceres CLONE 1414054-F
  misc_feature: SWISSPROT Homolog: EC 2.7.10.2 Non-specific protein-tyrosine kinase
  misc_feature (46)..(46): Xaa is any aa, unknown, or other
MSEEDVQPLECDNATAMRQASFAVDDAPRAVFPSIVGRAPHTGVMXGAMGKREKLGRRNSVQKGFRTWIPIGTGLAEMGRPWEKMGPPP

SEQ ID NO: 35024 - DNA, 750 bp, Zea mays
  misc_feature: Ceres CLONE 1414058-F
  misc_feature: Encodes the peptide sequence at SEQ ID NO. 35025
  misc_feature (1)..(1): n is a, c, t, g, unknown, or other
  misc_feature (2)..(2): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
nncccccccccccnnnnnnnaaccccnccnnnnnnnncacccgcccccgggcaaagctggagctccccgcggtggcggccgctctacaatagtggatcccccgggctgcaggaattcgcacgagaccattacctagaacatcctaatcgaaaactgttttgttctccttctcattcgactctgatgatgacgagacggttatcgttccccttctggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgtgctttgatccggagaccaccaatctgcatgcatctggccctgcaggtatggcagaatgcgtgaactcgtgtatccctacggagtgcgcagcagatccctctggcaggcaagggcggggcgaaaagaggtacgtgccggcggtcacgtcggggctaaatagcggtttccattctcgggcctggtttaaggccgtcctccctgggcccttttgggccaaaattccggctccaccatccttggggtggttaagtcccggatccccccgaaaggcaaggggcccctgcggggcggcgcctacctctatacggatagagggcccccttggggggccccccccgtcttgttggctggc

SEQ ID NO: 35025 - protein, 101 aa, Zea mays
  misc_feature: Ceres CLONE 1414058-F
MAECVNSCIPTECAADPSGRQGRGEKRYVPAVTSGLNSGFHSRAWFKAVLPGPFWAKIPAPPSLGWLSPGSPRKARGPCGAAPTSIRIEGPLGGPPPSCWL

SEQ ID NO: 35026 - DNA, 659 bp, Zea mays
  misc_feature: Ceres CLONE 1414060-F
  misc_feature: Encodes the peptide sequence at SEQ ID NO. 35027
aaagctggagctccaccgcggtggcggccgctctagaactagtggatcccccgggctgcaggaattcgcacgagaccattacctagaacatcctaatcaaaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgcggataagcaggggcggaagaaggcgtgtgtcacgtactgcatcacctacatcctcagctgcatcaccaagcactctccccagaacaaagtcttaatgatgggcgtgtcttgggtggaaatggcaatttcctgctctttccaagggttggagtccggcttccggggaaaaccaaacagaaaaggttttggcccccaagggttgccaaaaacttcccc

SEQ ID NO: 35027 - protein, 167 aa, Zea mays
  misc_feature: Ceres CLONE 1414060-F
  misc_feature (4)..(167): Pfam Name: DUF791 Pfam Description: Protein of unknown function (DUF791)
MEVFYYLVFGALAAIVAALELAKSGKDRVATSPAFNSFKNNYILVYSLMMSGDWLQGPYVYYLYSQYGFDKGDIGRLFIAGFGSSMLFGTIVGSLADKQGRKKACVTYCITYILSCITKHSPQNKVLMMGVSWVEMAISCSFQGLESGFRGKPNRKGFGPQGLPKTS

SEQ ID NO: 35028 - DNA, 682 bp, Zea mays
  misc_feature: Ceres CLONE 1414062-F
  misc_feature (659)..(659): n is a, c, t, g, unknown, or other
aagctggagctccccgcggtggcggccgctctagaactagtggatcccccgggctgcaggaattcgcacgagaccattacctagaacatcctaatcgaaaacgtatatgaatcttctcagacagaattccagggaggggatgttcagaaggtgcttatttcgttgttgaaaatattgtgccaacactatggaaagcttcgttcatcctttgggtctgacccgtcacaagagggtatagatggcccagagatggcagtgacgaaacttttctcatcttgtaagagcagtgctaatatgaaagggtatggagctgttgtccattgcatgagaaatcttccctcagaaagccagattcagactactgcccaggaggttcaaagtctcttggtttctggtagaaggaaagaggcccttcaccaggcacaagaaggtcacctttggggccctgcactgatccttgctttacaacttggtgataagttttatgcggatactgtgaagaaaatggcccactggcattttgtttctggatcacccttgaggacactgtgccttcttatttgctggacacctgcagatgtttttcagtttgagaatccctgttacagtggtttgtcttctccccacagcctgtagaggctgctcctaaagtatgctgnatgactggcaagagaattgggta

SEQ ID NO: 35029 - DNA, 673 bp, Zea mays
  misc_feature: Ceres CLONE 1414067-F
  misc_feature: Encodes the peptide sequence at SEQ ID NO. 35030
  misc_feature (568)..(568): n is a, c, t, g, unknown, or other
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (577)..(577): n is a, c, t, g, unknown, or other
  misc_feature (578)..(578): n is a, c, t, g, unknown, or other
  misc_feature (590)..(590): n is a, c, t, g, unknown, or other
  misc_feature (595)..(595): n is a, c, t, g, unknown, or other
  misc_feature (596)..(596): n is a, c, t, g, unknown, or other
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaaacttccccatcccgcttgctccgtgccgtggtctccgaggtcggggttcctttccgatttgatccgcccagctggaaaacgaaaatcgctgatgggttttggaaggaaagtcgtcatttcttggtgaggtttccgtttctggatcgactggctgatcgatcgtactagccgccatggcgtcgtcgtgcatcccggccggcggcatccggctgccggacctggagatggtcaaggccgcgccgccgccgccgccgccccgcccggcgcactcagcggcgtcctccacgctctcggaggcgtccaactcgtccccagcctcctcgtcgtcgttggcgtcgctgtcgctcaagcgcccgcgcacgccgcggaagcggcccagccagacgtacaacgaggcggcggcgctgctcgcgtccatgtacccctccgtattccccgtcgccaggggctgggggggccccgaggnngnngcacnncgcgctctcggnctcgnnctcgcgcttggcgacgacccgtcctgctccgacctccctcctcgttccccgntcccggaggcacgccgccttcctcc

SEQ ID NO: 35030 - protein, 132 aa, Zea mays
  misc_feature: Ceres CLONE 1414067-F
  misc_feature (98)..(98): Xaa is any aa, unknown, or other
  misc_feature (99)..(99): Xaa is any aa, unknown, or other
  misc_feature (101)..(101): Xaa is any aa, unknown, or other
  misc_feature (107)..(107): Xaa is any aa, unknown, or other
  misc_feature (125)..(125): Xaa is any aa, unknown, or other
MASSCIPAGGIRLPDLEMVKAAPPPPPPRPAHSAASSTLSEASNSSPASSSSLASLSLKRPRTPRKRPSQTYNEAAALLASMYPSVFPVARGWGGPEXXAXRALGLXLALGDDPSCSDLPPRSPXPEARRLP

SEQ ID NO: 35031 - DNA, 700 bp, Zea mays
  misc_feature: Ceres CLONE 1414068-F
  misc_feature: Encodes the peptide sequence at SEQ ID NO. 35032
ggagctccccgcggtggcggccgctctagaactagtggatcccccgggctgcaggaattcgcacgagaccattacctagaacatcctaatcaaaaagaggaagttcagttccgtgccgtgctcgcgcgcacccaccccgcacgccgcatgccgccttactccgcgctgctgctgctgctgggacgaagaaaatcttttccttcacctttctctcctctttcccagttcatgcacgggctctgattgacgccatgggggatgccgccgccgccgcaacggcctccacgtccgctcccgccacgcccacctccatcctcatctgcctggaggacggcagcgaccttctctccgacgcctacgatggcgccggcgccaccgacttcgtcgtcgcccgcgacgagcatctgcttgtcgaggaccaggacgaggagtacgtcgcgctgctcctgtccaaggagagcgcggcagtatgcgcccccggtggaggaagaaacccaggagtggatgaaaaccccacgcttcccgatgccgccgctgggatcatcaaagaccacggcgattgttcgggttcccgcaggaaagaccgcgtaacgctcgcaagtggacttaccctccaatccgcttttcctgggtttccaaccggccgcagttccaattaaggcggagaaacgcaagggcggctttctgccgggccctgccc

SEQ ID NO: 35032 - protein, 135 aa, Zea mays
  misc_feature: Ceres CLONE 1414068-F
MGDAAAAATASTSAPATPTSILICLEDGSDLLSDAYDGAGATDFVVARDEHLLVEDQDEEYVALLLSKESAAVCAPGGGRNPGVDENPTLPDAAAGIIKDHGDCSGSRRKDRVTLASGLTLQSAFPGFPTGRSSN

SEQ ID NO: 35033 - DNA, 882 bp, Zea mays
  misc_feature: Ceres CLONE 1414069-F
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (45)..(45): n is a, c, t, g, unknown, or other
  misc_feature (882)..(882): n is a, c, t, g, unknown, or other
ttttnnnnnnnnccccntttcccctccccgcgggtggtggggttntttgaaagtggggctccaccgcggtggcggccgctctagaactagtggatcccccgggctgcaggaattcgcacgagaccattacctagaacatcctaatcgaaaacagcccccagaaggtagagtccagggctcactcgcgaccgagagtcacagacaaatggggggcccaggccgtccttggcgccgagacgtcttagtccttcaggtagctgtagcttctcctgtggggagccgggcctggacagacggccgctcatggtctaaagttgagaaggcgggactgttcccgggccctcggcgcttggtgccgggggcttcatattacaaataccagtgtgcggtttagatgaagaagggaagtatggcacacccccccgcccaggggggggggggggggggagaagtgtgatcgccccgtgacacgcaatactctcgggggcccggagcgccgggtacgcgtcctctccctgcccaattacctcgtgcgtgctcgcggccgcatcgccgccacgggccgcctgccctcccggcacgctccccccccactcggggcccggctttaaattgggagcgacggggtggccacgcgggattggggtccgggggggggggggggccaacacgccaagaggccccgacaccgggggcggcgatatgaaggcccaacacaaccataccaagcccggcgtactccataaaggaccgcgctgggaggaccgtgcgcgagagaccaagcgcgcccgcgcctgctggggcagggcggttcgacaatattctgttatatcaagagctctcgagtttttctccgcgcgcgggtcggcgcgctggtggcgn

SEQ ID NO: 35034 - DNA, 491 bp, Zea mays
  misc_feature: Ceres CLONE 1414078-F
  misc_feature (157)..(157): n is a, c, t, g, unknown, or other
  misc_feature (158)..(158): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
aaagtggagctcaccgcggtggcggccgctctaaactagtggatcccccgggctgcaggaatccacgagaccattacctagaacatcctaatcgaaaaagccagcaggacacccactcatcttcttctcccccgcctcgtttcatcgccaccacccnntcttctcctggggggtccctccccgttccaaattcccaaaannnccccttggcctcggcttcatgaagtgcgcatgaaaagctctccgcccacgtgcggggccggggggcccccggggaaagggaaaccccgggaacctccccccccgccccccaaaggggaacggcccccccgggaaaaaaaccccaaaaaggggggggaacccggaagggggtgtccccctttttgaaaaaagtaaaatttttaaaacccccccttaaatggagaaaagagattggcgcccccaaaaccgtttaaattttttataaaccccccccccctgtggggggagaa

SEQ ID NO: 35035 - DNA, 710 bp, Zea mays
  misc_feature: Ceres CLONE 1414080-F
  misc_feature: Encodes the peptide sequence at SEQ ID NO. 35036
aaagctggagctccccgcggtggcggccgctctagaactagtggatcccccgggctgcaggaattcgcacgagaccattacctagaacatcctaatcgaaaagtgagtcgtgagtagtgactcgtctggtctcccctctctcgtccgtctggtcctcccgtccagaggcgttctctctccctccccctttcctctggtcatcgcacccgtctccccgctctgactccgcccgcgccgccgactcccggcacggccccaggcttcatctccgccgccgcgccgcctcgctccgatcgacccccgaaacgccggaaaccgtgggcttcgcgaggtgcaatttcttgggccgcgtctgagcttgattcagtttctggaaagcggctgagcttgggatttgatccgggttgcctctcttcgtccaagggtagattacataacagtgcacaggtgatttgcaaagagaagggggcatttggtccctgtatgatggcggaaggccccaatttccctggattgatgaaagccatgccaaggggggggatttctgggaatagggtaactacccggaagctcggtggggggtccaaacttgggggggaaaaaccttaaaaaaaggggaacccccccccggggggggccccttggaaagggggggggaaaaacaagaggagggggccgggggcccccccaaaaggggggccaaacccccg

SEQ ID NO: 35036 - protein, 40 aa, Zea mays
  misc_feature: Ceres CLONE 1414080-F
MAEGPNFPGLMKAMPRGGISGNRVTTRKLGGGSKLGGEKP

SEQ ID NO: 35037 - DNA, 746 bp, Zea mays
  misc_feature: Ceres CLONE 1414084-F
  misc_feature: Encodes the peptide sequence at SEQ ID NO. 35038
  misc_feature (675)..(675): n is a, c, t, g, unknown, or other
  misc_feature (677)..(677): n is a, c, t, g, unknown, or other
  misc_feature (746)..(746): n is a, c, t, g, unknown, or other
aaagctggagctccccgcggtggcggccgctctagaactagtggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgaagacgcgtagctcgagggttcgtgatttctcgccgatcggttcgggaactggtaagctatggatctctcgcggcccgcatcgtcagacctctcgctcgggctgaactctcatgcccacgcccacgctcgggtgcatggcgcaagcgccgccgctgcccttgttcaacaacccgaaacccgaaacccctcgtggcccgggaaggcccaccccgaaaaaggaccaaccgggaacggggggaaccaaaaattttcccctcctcgggaactcccttttgggtaaagggccccggcccgccccctaaaaananttgtggggccggggtttaaaaaaattttttcctggttctcccccgggggtgggcccccccaaaaagggn

SEQ ID NO: 35038 - protein, 37 aa, Zea mays
  misc_feature: Ceres CLONE 1414084-F
MVFSDAASPLVATAADSASSCVAHLPCCCRVSCCRCC

SEQ ID NO: 35039 - DNA, 557 bp, Zea mays
  misc_feature: Ceres CLONE 1414087-F
  misc_feature (169)..(169): n is a, c, t, g, unknown, or other
  misc_feature (184)..(184): n is a, c, t, g, unknown, or other
  misc_feature (204)..(204): n is a, c, t, g, unknown, or other
  misc_feature (217)..(217): n is a, c, t, g, unknown, or other
  misc_feature (219)..(219): n is a, c, t, g, unknown, or other
  misc_feature (220)..(220): n is a, c, t, g, unknown, or other
aaagctggagctccccgcggtggcggccgctctagaactagtggatcccccgggctgcaggaattcgcacgagaccattacctagaacatcctaatcaaaaaaaaatcgagctgtcccctccctgtgctctactgctcttgcgccttgctagcttgcttgcttccctgntccctccctcctccntctcgtcgctcttctctggntcttctggtgttngnncgacgagctagcgcaagggaaggagtggctcagcagagtcatcgggctaccaaggcgctgcctgtgggctgcattgcaactttcagggaaaacctgaatatggaaatcacttattgcaaatgaactgagcagaaaccccagttgctaccgtgccttggggcaatggccaaaacaaggttccaaaaagaaccccctcctcaaatttaaagatccgggcccaaagcaattaaggggttttcctgtaaaaaaataaaccaacggcgccccctggggaaaacccttggtcccttcctttttttttaggggggggtgaagggacaaaaacccactgattact

SEQ ID NO: 35040 - DNA, 702 bp, Zea mays
  misc_feature: Ceres CLONE 1414088-F
  misc_feature: Encodes the peptide sequence at SEQ ID NO. 35041
  misc_feature (512)..(512): n is a, c, t, g, unknown, or other
  misc_feature (559)..(559): n is a, c, t, g, unknown, or other
  misc_feature (590)..(590): n is a, c, t, g, unknown, or other
  misc_feature (621)..(621): n is a, c, t, g, unknown, or other
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaagacgacgagataaagaagagaacccaccaaatcaaaggcggacacatcgccacatcctccattccgccttctcggctcctccccacctggccaccactaccacctcccgtctcctcgcctccttccaaatccaccggttgccatccgtccgacgaggacggaaagggaccggcgtgagggaaacctagatgacccgttcctgggtcgggaccagagagccttccgggctgcgccttcgatcgccgccccgccgcctagggttcccgcgcctgtagatcgggtttggaggacgaggaaggggagtgccaagtaagggaacgatggggccgaggcgctccaagcgcgtttcgtggggcaccggggccaatctctgcaaggtaaggttttttatttcggaggattccccttctncagctggattgagacccgcagacaatctccaagcaaaagctcatggntaatgcatgcagctggcccaagctcagatgnatcgctgccacctggcttcaatcattgcagncaacagctgtctcaaattgactatccaaatcatggtattaanggggagatgccaccacagtatggataaccctgttggctg

SEQ ID NO: 35041 - protein, 46 aa, Zea mays
  misc_feature: Ceres CLONE 1414088-F
  misc_feature (31)..(31): Xaa is any aa, unknown, or other
MGPRRSKRVSWGTGANLCKVRFFISEDSPSXAGLRPADNLQAKAHG

SEQ ID NO: 35042 - DNA, 759 bp, Zea mays
  misc_feature: Ceres CLONE 1414091-F
  misc_feature: Encodes the peptide sequence at SEQ ID NO. 35043
  misc_feature (343)..(343): n is a, c, t, g, unknown, or other
  misc_feature (566)..(566): n is a, c, t, g, unknown, or other
  misc_feature (630)..(630): n is a, c, t, g, unknown, or other
  misc_feature (689)..(689): n is a, c, t, g, unknown, or other
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaaagtatcacagccgcacagcgcccgctgctacgcacgccgccgtctacccccactcccccagcacgtgcgtgcacgcgcaggtgctcgaggacttctcccccgtttccgcccacatccgccgacctgcctcgccattccgccgcgccttcgcatcgtccgcgcgcccggcccttctcgttctaccccggtacgactcgacggtggtcgtgggcgccgaaggtgcggctccgaggcgccaggntggttcgtttgctgtttgcgcgatcgccggaggagtctgtgcaagctgtgctggctaaggggtttggggggttcggattcagtgggaggggctgcggcaggagggagctagagatgtacggaccgccgtcccgagggcggcggggagctggcactgccggagagcagcctagggttttaccaagtttggcgaggaagcaacgagttttttcttgcaaggccgnttcatatttggacctgatgtgagatcattgtttctcaccatattcctcattctgcgccaatggngggcttctgtatatttgtggccagacatcttatcaatgactttctgatcaatggggagnttcagttatggncatagtgattggcctcactgtataacgattacattgctgcttctaccttctgaagaaa

SEQ ID NO: 35043 - protein, 43 aa, Zea mays
  misc_feature: Ceres CLONE 1414091-F
  misc_feature (37)..(37): Xaa is any aa, unknown, or other
MYGPPSRGRRGAGTAGEQPRVLPSLARKQRVFSCKAXSYLDLM

SEQ ID NO: 35044 - DNA, 728 bp, Zea mays
  misc_feature: Ceres CLONE 1414092-F
  misc_feature: Encodes the peptide sequence at SEQ ID NO. 35045
  misc_feature (342)..(342): n is a, c, t, g, unknown, or other
  misc_feature (425)..(425): n is a, c, t, g, unknown, or other
  misc_feature (487)..(487): n is a, c, t, g, unknown, or other
  misc_feature (488)..(488): n is a, c, t, g, unknown, or other
  misc_feature (504)..(504): n is a, c, t, g, unknown, or other
tggagctccccgcggtggcggccgctctagaactagtggatcccccgggctgcaggaattcgcacgagaccattacctagaacatcctaatcgaaaacttcccctctctcgcccctcctccctccgtctcgtctcccaggtcatggcaaaagctggagcaccgggaaaaataacaagtgggagataaacaggaagagctaggtgaatacttgggagaaaaaggtcccccacaccccccacgcaggtgaatactacaagtagcagtacaaggaagagagccaatctgcccgtgactgccagtgagttgctcggggtgtggtggtttagttgaggtcacgatgnatgggaggcgggctgatgatggatcagagcgctgttccctggcgtccacaacttcgtggatctcctgcagcagaacggcgacnagaacctgggcttcgcctcactcatgccgcagacgtcctccggcgaccagtgcgtgatgggnngggagggtgatctcgntggacccaccgccagacagcttcccggacgccgtggaggacgacagcgatgacgacgttgaggacatcgaggagctggagcgccgcatgtggcgcgaccgcatgaagctgaagcggctcaggaagctgcagcaaagccgcggcaagatcccttggcttaagcggtgggggcctggccgacgttcatccaagccagggcagccgagggacagccccggcgcaaga

SEQ ID NO: 35045 - protein, 46 aa, Zea mays
  misc_feature: Ceres CLONE 1414092-F
MWRDRMKLKRLRKLQQSRGKIPWLKRWGPGRRSSKPGQPRDSPGAR

SEQ ID NO: 35046 - DNA, 799 bp, Zea mays
  misc_feature: Ceres CLONE 1414096-F
  misc_feature: Translation starting site: 436
  misc_feature (145)..(145): n is a, c, t, g, unknown, or other
  misc_feature (294)..(294): n is a, c, t, g, unknown, or other
  misc_feature (433)..(433): n is a, c, t, g, unknown, or other
  misc_feature (434)..(434): n is a, c, t, g, unknown, or other
  misc_feature (442)..(442): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (521)..(521): n is a, c, t, g, unknown, or other
  misc_feature (522)..(522): n is a, c, t, g, unknown, or other
  misc_feature (524)..(524): n is a, c, t, g, unknown, or other
  misc_feature (525)..(525): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (577)..(577): n is a, c, t, g, unknown, or other
  misc_feature (588)..(588): n is a, c, t, g, unknown, or other
  misc_feature (610)..(610): n is a, c, t, g, unknown, or other
  misc_feature (665)..(665): n is a, c, t, g, unknown, or other
  misc_feature (788)..(788): n is a, c, t, g, unknown, or other
aaagctggagctccccgcggtggcggccgctctagaactagtggatcccccgggctgcaggaattcgcacgagaccattacctagaacatcctaatcgaaaaagaatcttctgccactgcccttccatctcgtcccttagctacnagtcatctcgccgcaaccggaacccgcagccatggggacggaggcggagcagccggacatggacagccaccgaaacgacgggcgtcgtggtggtgccagcgccgcgcccgcgtaaggggctcgcctcctgggcgcttgacctgctcgangtccctcgccgtgcgcctcggccacgacaagaccaagccgctccactggctctccggcaacttcccgcccccgtcgtcgaggaagaccccgccggccccaaaccttaagcgtccgcggacaccctcccggagtgcttgnnaatggagnagttttgggtcagggttggccccttaaatccgaagtttgcttcccgtgttgcgnnngtatcaccttggttttggatggnnannacgnnnattgattcatgccatggcgttattaaagggatgggaaaagctaccntatggtatcanggataatgtgaaagactgcccngctcaaacaagagggggaggaattttggtgggagcaaagttttatggaagatggnagacctaaaggggattttttttggggatggttaaggggccaaatggagcaacttcgaaaaaaatcaaaagggctgggatttaacctatgggattgggaaagctaaaccgggaggggttaattnatttgggaaat

SEQ ID NO: 35047 - DNA, 724 bp, Zea mays
  misc_feature: Ceres CLONE 1414097-F
  misc_feature: Encodes the peptide sequence at SEQ ID NO. 35048
  misc_feature (120)..(120): n is a, c, t, g, unknown, or other
  misc_feature (321)..(321): n is a, c, t, g, unknown, or other
  misc_feature (446)..(446): n is a, c, t, g, unknown, or other
  misc_feature (512)..(512): n is a, c, t, g, unknown, or other
  misc_feature (519)..(519): n is a, c, t, g, unknown, or other
aaagctggagctccccgcggtggcggccgctctatcctagtggatcccccgggctgcaggaattcgcacgagaccattacctagaacatcctaatcgaaaagagctcaaacacacatcangaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccnaccgggccggcgggttccccagcagtgtggcactgacgaaacgcttcagcggccgtcgtcgttctcgcgcttatcttgtcgtcgcctcggcgacgagagccgaacaggaggtcgcccctgtgagnattcgaggacgtggacctcagctctcatcagggcgcgggccgacgacggggagttcgccgcgcggntggcggnaggtccacgccacaacaaactgggaagggtctgctgaaccccatcgacggggtgctcctccaggagtcatccgctacggggagttccccaggccaactacaacagcttcaactacgaccgcttctccccctacgggggcagctgcagaacccggggaaaaccttcttccacgaggtcggctcgggggttttaggataacaggccc

SEQ ID NO: 35048 - protein, 94 aa, Zea mays
  misc_feature: Ceres CLONE 1414097-F
  misc_feature (17)..(17): Xaa is any aa, unknown, or other
  misc_feature (59)..(59): Xaa is any aa, unknown, or other
  misc_feature (81)..(81): Xaa is any aa, unknown, or other
  misc_feature (83)..(83): Xaa is any aa, unknown, or other
MAATVSSCLSLVPTVHXPGRRVPQQCGTDETLQRPSSFSRLSCRRLGDESRTGGRPCEXSRTWTSALIRARADDGEFAARXAXGPRHNKLGRVC

SEQ ID NO: 35049 - DNA, 734 bp, Zea mays
  misc_feature: Ceres CLONE 1414102-F
  misc_feature: Encodes the peptide sequence at SEQ ID NO. 35050
  misc_feature (602)..(602): n is a, c, t, g, unknown, or other
ggagctccccgcggtggcggccgctctattactagtggatcccccgggctgcaggaattcgcacgagaccattacctagaacatcctaatcgaaaaacaccccggtcggctagtcccaaggctgctgccgccgcctgctgctaggggatcgcttgctttcctcggaccactctgccgaccacatctacaccgcatcaacggtccttccaagtgagctccaatcccctgtctgtagatggagagggtgctcaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgttactgttacaaatgatggggctaccattttgaagtcacttcacattgacaatcctgctgcaaaggtccttgttgacatctcaaaagttcaagatgatgaagttggtgatgcgacaactttctgttgttgttctagctggagaacttttgaaggaggctgagaagttaattaacatgaaaattcatccaatgactattattgcaggntacagaatggctctcgagtgtgccagagattctttgctaaaaagaccctggaccaccaaaaaataccggataattcgatctgatctcatgaatatgctatgactactcctaagtcaaaatactttccaagag

SEQ ID NO: 35050 - protein, 106 aa, Zea mays
  misc_feature: Ceres CLONE 1414102-F
MERVLKDDAVEEKGERARMASFVGAMAISDLVKTTLGPKGMDKILQSTGRGRNVTVTNDGATILKSLHIDNPAAKVLVDISKVQDDEVGDATTFCCCSSWRTFEGG

SEQ ID NO: 35051 - DNA, 693 bp, Zea mays
  misc_feature: Ceres CLONE 1414104-F
  misc_feature: Encodes the peptide sequence at SEQ ID NO. 35052
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (389)..(389): n is a, c, t, g, unknown, or other
  misc_feature (391)..(391): n is a, c, t, g, unknown, or other
  misc_feature (599)..(599): n is a, c, t, g, unknown, or other
  misc_feature (635)..(635): n is a, c, t, g, unknown, or other
ggagctccccgcggtggcggccgctctagaactagtggatcccccgggctgcaggaattcgcacgagaccattacctagaacatcctaatcgaaaacttctgccattccgccgaacaccttccccaatcgtgcgcctccggccatgggggaagcctccgacgcggcggtagccgtatctgcgcggctcctggnnnaaaggccttgggggccggggcccccgaaaaagaaaacgaaacttccttggccaaaggccgggccccttcccggggggggggaaaaccccttcccttttggcgggacaaccaccccggtccgcttgctgacgagcccgcgccgtggtactccccggcgcgcggcgcgaagcctatgaccccgctcatggtcgcgncngcgtacgggtccgtggcctgcatcgatgtcctactctctccgcccccacaaaccggaccccaaccggcgccttaacggttgtcccttctcccaccgggggttttaattttggaagccggggggggggggcccctcccgtttggccccggcttgggaaaaaccccggtctccaaaactgggtggggggcagggaacacacgattttggntcaaaccacactctccaaagccacaaaacggtttanaaaattataaaaaaaccctctgaggtagcaaattttgtgttgcagaggaaaaaaaaat

SEQ ID NO: 35052 - protein, 32 aa, Zea mays
  misc_feature: Ceres CLONE 1414104-F
  misc_feature (8)..(8): Xaa is any aa, unknown, or other
MTPLMVAXAYGSVACIDVLLSPPPQTGPQPAP

SEQ ID NO: 35053 - DNA, 707 bp, Zea mays
  misc_feature: Ceres CLONE 1414106-F
  misc_feature: Translation starting site: 379
  misc_feature: Pfam Name: SSIII Pfam Description: Starch synthase III
  misc_feature: SWISSPROT Homolog: EC 2.4.1.21 Starch synthase
  misc_feature (19)..(19): n is a, c, t, g, unknown, or other
  misc_feature (319)..(319): n is a, c, t, g, unknown, or other
  misc_feature (355)..(355): n is a, c, t, g, unknown, or other
  misc_feature (356)..(356): n is a, c, t, g, unknown, or other
  misc_feature (438)..(438): n is a, c, t, g, unknown, or other
caaagctggagctccccgncggtggcggccgctctagaactagtggatcccccgggctgcaggaattcgcacgagaccattacctagaacatcctaatcaaaaaataatccagtattccaggcgttcttccctctccctcctttgctatttttctgctgctcctccacctcttctgttatgtttggtgaagggctgaaggtaagaagctgggaacgtgcagcaaggctgcaaaaacatgtccattaatccagtcagggttcccttggatgcatatatgatggactttgtcttctctgagtcagaaggtgtatatatgancataggaatgggatggactatcatattcctgtgtcnntgatctgtgcaagggaactcccatgcatattgtacacattgcagtggaaatggctcctatcgcgaaggtcgaggccctgggntggatgtgttaccaagcttttcacgagctgttcaagattagggcattaaagtttgagggtattctgccgaaatatggttggttaaaccttaacggggggaaggatttacccttaccaccaagtttttacgtggggggggaaaaaaataaaaattatggttttgaaaagggtaaaaactcccctggttttttttcttgaaccaaaaaagggagggttttgggggttggaagggtcccccgaaaaaaagggggagagaaaatttggttttt

SEQ ID NO: 35054 - DNA, 966 bp, Zea mays
  misc_feature: Ceres CLONE 1414107-R
accgggccccccctcgaagtcgacagtatcgataagcttttttttttttttttttaaatcacttacgtttctcgtgcatgcctctcgcttaatggttacaggcatcttgagccccagttaccaacggtgtcagcacgtattctatcgggaatttatatcctatacacccaaaactatgtcacactatttatccacattttattccttgcaaattttggatcaacactgtcaaatcctaccactgaactcttcaattgggagataaaaccattcaccctcattttaaagcgcttgattctcaaattcctctgtggcccatcccaaatcttccacaaatcccccttgaaaattaaaacccccccttccccccgaagaaaaaaaccggaccccaaggaattttccccctttaaaaaaaaacttccccaacctttttttcccccggaaaagtttttccccccccacccaatggaattttttcaaaaccttctttgaaaaccccccccccctcccccggaaaatattttttcccaacccaaaagtgggatagtttcaaacaatccccccccaaattcttccccccttgtaaacaaaaatccccccccccccctcctgtttgttggaaaacaaacaaaaaaacacccgcttctttttcttgggggggatttaaaaaaaactttttttaaaaaacccccccctttaattccccccccccatatgcccaattttttgccgaaaagaaaaaattttttttaaaaaatatttccccgtgtgttcctcccctataaaaaatttcccccccgggtactccccataaaaacaaaaaccccaccctttggctttttaagaaagaaattttctttaacaccccctcccccgattatggctattttcggcccaaaatattaaaaaccccccacttttttttttaaaaatatatccctccccctttttataccccgcgctccc

SEQ ID NO: 35055 - DNA, 728 bp, Zea mays
  misc_feature: Ceres CLONE 1414108-F
  misc_feature: Encodes the peptide sequence at SEQ ID NO. 35056
  misc_feature (301)..(301): n is a, c, t, g, unknown, or other
  misc_feature (365)..(365): n is a, c, t, g, unknown, or other
  misc_feature (376)..(376): n is a, c, t, g, unknown, or other
  misc_feature (383)..(383): n is a, c, t, g, unknown, or other
  misc_feature (565)..(565): n is a, c, t, g, unknown, or other
  misc_feature (617)..(617): n is a, c, t, g, unknown, or other
catagctggagctccccgcggtggcggccgctctattactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgaggnagcattgcggtggtccgatcgcccgcggggggccatggcgtctgtggcgggatcgggcggcggngcaagcgcggnggccggntgggttgaagacttacttcaagacccccgaggggcggcacaagctgcagtacgagaagacgcactcccccgccgtcgtgcactacaaccacaacggcaagaccgtcgcccagatgacggtggcatatttgaaggagaagccagcaggccagggttccacgccttcacaccaagtgctggtantgggatgcggtctgcagctgcgagactgcttggcactgggaatggtagccgnacacttagcttcgggagcatggtacccagcagggctgtctcaagagcagccgctgggtgaaagggtattgttggggcaactaatggcagggggacgcaaggcatggcaaat

SEQ ID NO: 35056 - protein, 113 aa, Zea mays
  misc_feature: Ceres CLONE 1414108-F
  misc_feature (14)..(14): Xaa is any aa, unknown, or other
  misc_feature (77)..(77): Xaa is any aa, unknown, or other
MASVAGSGGGASAXAGWVEDLLQDPRGAAQAAVREDALPRRRALQPQRQDRRPDDGGIFEGEASRPGFHAFTPSAGXGMRSAAARLLGTGNGSRTLSFGSMVPSRAVSRAAAG

SEQ ID NO: 35057 - DNA, 725 bp, Zea mays
  misc_feature: Ceres CLONE 1414110-F
  misc_feature: Encodes the peptide sequence at SEQ ID NO. 35058
  misc_feature (626)..(626): n is a, c, t, g, unknown, or other
ggagctccccgcggtggcggccgctctattactagtggatcccccgggctgcaggaattcgcacgagaccattacctagaacatcctaatcaaaaaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggaaccgcggcgggagacgaatcccaagaagcgggtggtgatcacggggatggggctggtctccgttttcgggaacgatgtagacgcttactacgaccgcctgctagtcggggagagcggcatcgggcccatcgaccgcttcgacgcttctaagttccccacccgctttgccggtcagatccggggcttctcctccgagggatacatcgacggaaagaacgaccgccgccttgatgattgcctccgatactgaatcgtcagtggcaagaaggctctcgaggcctccggtatcgcccacggntccaaggccatggaaaagattgacaagaccccgggccggtgtgcttgagggcacctggaaagggtgacctcccggggtttttcgggaggagccacaaac

SEQ ID NO: 35058 - protein, 120 aa, Zea mays
  misc_feature: Ceres CLONE 1414110-F
  misc_feature: SWISSPROT Homolog: EC 2.3.1.41 Beta-ketoacyl-acyl-carrier-protein synthase I
MQSLLLPTAAVAPVAPPCGRRNLPGRLSVRASATVVAEPRRETNPKKRVVITGMGLVSVFGNDVDAYYDRLLVGESGIGPIDRFDASKFPTRFAGQIRGFSSEGYIDGKNDRRLDDCLRY

SEQ ID NO: 35059 - DNA, 719 bp, Zea mays
  misc_feature: Ceres CLONE 1414114-F
ataagctggagctccccgcggtggcggccgctctagaactagtggatcccccgggctgcaggaattcgcacgagaccattacctagaacatcctaatcgaaaaacccggcagtcacacctcgaaagcaacagcaagtcagcaacctacctagctagagctatcactatatcagtatcaggtacctagacctagcagcagccacacccacaccgtacgtcggcatggctaggtggtcgtcgtcatgctctggtcgccgtcctcgtgcctgggccgaggcggtggcgtgttccgagcagcgccccgtcgccgagcgtggttaaaagtcggcagatgacgtgacctgcgaggaacggctagattcaggttgcggtgctgatgcctccgatgcgccgaatccgataggattgcgaatacgtagcgaagatcgggggttggtgacacaggagcacggccgtgacgcacgtgcagctactcccgggcgcgaggactcctgagtgacgacccggggttcgagtgcccatcccctccttgaccggagagagacttcagtgaacagaagccgtgctgggaatgtggatccacgaaaagctcgatggttcttctcatttcccggcaggaggctagatacgagaaaggactagtccccttggtacgattaaataccccgggtaggcggctgcatgtaagttggattcaggagaacggtttttgtgtttat

SEQ ID NO: 35060 - DNA, 727 bp, Zea mays
  misc_feature: Ceres CLONE 1414116-F
  misc_feature: Encodes the peptide sequence at SEQ ID NO. 35061
  misc_feature (406)..(406): n is a, c, t, g, unknown, or other
  misc_feature (703)..(703): n is a, c, t, g, unknown, or other
aaagctggagctccccgcggtggcggccgctctataactagtggatcccccgggctgcaggaattcgcacgagaccattacctagaacatcctaatcaaaaaatatcccttcctcgtatatcctttcctgagtaggagagagagttgagttaggagttgttgtgctgatcatctcggtcgaccgagagatggaccaccacttcactgagatagaggggaagatggcgcacgagccactggcacacagctccaccttctccgatgagacgaaagacaaaatggagcacgattcactggtgtacagtccacgcagcatcgcgagggccacaaccaccggcatccctgtcggcgatcaaggcgtggccgtgctacgtgggccgcttatcgtgggtgcagggccggcggntctggcatgcgcggcgttgctcaccatgttatacattccctacgtgctcctagagcgcgacgtgtgcgtagcctcaatgtggcaccgccgcacgtaccgcaggttgtgtctgcacctacccaagcgctactgtgagctcccgctcatgcacttcccacgcacctaccccacatatcccacccggcaagcagttcttgtctacctcaatgagtacatggcgcgcatttggcatccgcccattttccaagcctcgaggttgtcgctgccgagtacaacggtgaaatactgttggtgtcngaacaaagatgtcatccccactgc

SEQ ID NO: 35061 - protein, 179 aa, Zea mays
  misc_feature: Ceres CLONE 1414116-F
  misc_feature (73)..(73): Xaa is any aa, unknown, or other
  misc_feature (172)..(172): Xaa is any aa, unknown, or other
MDHHFTEIEGKMAHEPLAHSSTFSDETKDKMEHDSLVYSPRSIARATTTGIPVGDQGVAVLRGPLIVGAGPAXLACAALLTMLYIPYVLLERDVCVASMWHRRTYRRLCLHLPKRYCELPLMHFPRTYPTYPTRQAVLVYLNEYMARIWHPPIFQASRLSLPSTTVKYCWCXNKDVIPT

SEQ ID NO: 35062 - DNA, 683 bp, Zea mays
  misc_feature: Ceres CLONE 1414118-F
  misc_feature: Translation starting site: 214
  misc_feature (307)..(307): n is a, c, t, g, unknown, or other
  misc_feature (330)..(330): n is a, c, t, g, unknown, or other
  misc_feature (373)..(373): n is a, c, t, g, unknown, or other
  misc_feature (383)..(383): n is a, c, t, g, unknown, or other
aaagctggagctccccgcggtggcggccgctctagaactagtggatcccccgggctgcaggaattcgcacgagaccattacctagaacatcctaatcgaaaaagcatatgcacaaaatctcatttgagcgtgcaagctccttcgcctcgaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtgnccaacatcgtcaaatcctcgctncggccccgttggtctcgacaagatgctagtggacgatattggntgatggtacnatcactaatgatggagcaccatacttaaagatgtggaagttgagcatccagccgccaaggggtcttgggtgagttgctgagctcccagatcgtgaggaaggagaatgaactactttccggtggcatcataagcggagagttactcaagaaaggcatgattcttgggaaaaataaaatccatccaactcctaaaacaggggctacaggcttgctatgggggaaacccgaaaaaatggtgaaggaaaggtatcaagccagggtgaaaaacttggaaaaaaactccctaacaaccctggaaaa

SEQ ID NO: 35063 - DNA, 707 bp, Zea mays
  misc_feature: Ceres CLONE 1414120-F
  misc_feature: Encodes the peptide sequence at SEQ ID NO. 35064
  misc_feature (415)..(415): n is a, c, t, g, unknown, or other
  misc_feature (429)..(429): n is a, c, t, g, unknown, or other
aagctggagctccccgcggtggcggccgctctagaactagtggatcccccgggctgcaggaattcgcacgagaccattacctagaacatcctaatcgaaaagacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgcccctcgacaggatgggatccgcacgggggttgacctgctgccgcgctgcnatgacatggtcagnaagctcggcctcttctccccccacgagaccaaggaggacgtctccacagcaaacctcaagtacctactggtcccatattaccttgcagaaatgaccgaaagatagcacaggaggatcggatcccggttcctaggacgccacaggaccatctgagggagttcattgctctatgtggaagactaaagcttatccccggagatgagctagaattgtctaggcagaagcagccagatactctgacaaacagagaagggagaaaggtgcccgtttcaaacgta

SEQ ID NO: 35064 - protein, 103 aa, Zea mays
  misc_feature: Ceres CLONE 1414120-F
  misc_feature (65)..(65): Xaa is any aa, unknown, or other
  misc_feature (69)..(69): Xaa is any aa, unknown, or other
MVDVEETGNKLQSQMRLHAEPEDDAADLPLPALFDRASRLHALASSSAPRQDGIRTGVDLLPRCXDMVXKLGLFSPHETKEDVSTANLKYLLVPYYLAEMTER

SEQ ID NO: 35065 - DNA, 703 bp, Zea mays
  misc_feature: Ceres CLONE 1414129-F
  misc_feature (423)..(423): n is a, c, t, g, unknown, or other
  misc_feature (469)..(469): n is a, c, t, g, unknown, or other
aaagctggagctccccgcggtggcggccgctctagaactagtggatcccccgggctgcaggaattcgcacgagaccattacctagaacatcctaatcaaaaattcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccatcgcgtactacacccgcctcatccgcaccgagcggtacacgccgattatcccccccgtcaataccaccggtctcgggcgtccccatccgcctgctcgcgctctccgtccccgnatcccgacgtcccgtcgggccccgggcggtcgacgagtcctacacngctctccgtgccacccaattccagctccgctgacatctctgccgccactccctgggcaatcatccgcggtctcgagaccttctcccagctcgcctggagcagcggcgccgccgacgcgagcggccagccgatcgtccccagcgagatagaaatctccgaccacccctgtcaccccaccgcgggatccctctcgacacgcacggaatacttaccccgtccgtgacatcctccgat

SEQ ID NO: 35066 - DNA, 759 bp, Zea mays
  misc_feature: Ceres CLONE 1414132-F
  misc_feature: Encodes the peptide sequence at SEQ ID NO. 35067
  misc_feature (462)..(462): n is a, c, t, g, unknown, or other
aaagctggagctccccgcggtggcggccgctctagaactagtggatcccccgggctgcaggaattcgcacgagaccattacctagaacatcctaatcgaaaaatcgcagtcgcaacgaagcccccccacacacaaaaaagcaaaagcatcatcacaataatggcccgcgcgtgcgtgttcctcgtggtgctcctcctggccgccgtcgcggtggcgccgtttgcgggggctgcgcgcgtggatgtcgtggagggcaggtccatggcgtccgccgacgcgcctgaggcggcggctgacgcgcccgctcctggtcccgactcccgctcatctccggactcgtcgtcggaggcgccctccagcagcagctcatccgactagccgcgcacaacgcagttcttgtcatgatctatctagcaaataaaaagatcatgtctcatttgattatctgggaatactaatagnatatatgctgggcccccgaatgatatttaaattatgtgcatgaaatgcggggcggcaaacccagggtatggtgctgcccgcaaaaaaaaatggggggggggtccttttttcccccttaactttcccacaaaccgggcccccccccccgggggataaatttttcctgcgggggggaaaaaaaaaagggggaaaacccaaaattgggacggcggtttttccccaaaaaaaaaaaaaaaaagttttttactcccgcccaccccgggggggggcccccgaaaaaaattctccccttaaaga

SEQ ID NO: 35067 - protein, 72 aa, Zea mays
  misc_feature: Ceres CLONE 1414132-F
MARACVFLVVLLLAAVAVAPFAGAARVDVVEGRSMASADAPEAAADAPAPGPDSRSSPDSSSEAPSSSSSSD

SEQ ID NO: 35068 - DNA, 755 bp, Zea mays
  misc_feature: Ceres CLONE 1414134-F
  misc_feature: Encodes the peptide sequence at SEQ ID NO. 35069
  misc_feature (445)..(445): n is a, c, t, g, unknown, or other
  misc_feature (471)..(471): n is a, c, t, g, unknown, or other
  misc_feature (488)..(488): n is a, c, t, g, unknown, or other
  misc_feature (489)..(489): n is a, c, t, g, unknown, or other
  misc_feature (550)..(550): n is a, c, t, g, unknown, or other
  misc_feature (588)..(588): n is a, c, t, g, unknown, or other
  misc_feature (610)..(610): n is a, c, t, g, unknown, or other
  misc_feature (653)..(653): n is a, c, t, g, unknown, or other
caaagctggagctccccgcggtggcggccgctctagaactagtggatcccccgggctgcaggaattcgcacgagaccattacctagaacatcctaatcgaaaagcttccccccacaggcccacactctcgccgtctcgcgcgcatcacggcggcggcggcggcagcgaagcaccgcgtggccctccacctaagtcctagcccaagcgtaagcgatcgctctccccatcagccactatggcgccacgcccccgcaagcgggcctcgcgccccaagccccgcccgggctcccgacgtggcggcggcggaggggacgacgatcccttcttcgagtccgagcccaagcgccgccgtggaggccgtgacgaggacatcgagagcgaggacagcgacgacgatggcgtgggctgcgtttggggggcggatttggatgagggatggggacgnagcggcggttagggaaggaggaggancgagggagacggtgggnnggaagaagaaagatggcggatgggacgaaggagtgggctggaagaaaggtcactggaggtncgctaaagagggggcagggaggatggacgacgaggacngagtcgggaaggggagaacggntgggcggagatccctgcagagaaagcagctttgaggagagcgncaggaagcgggagggagattgctgcgagggtattacaccgggccctcaggatggttttaaagttctgtgaagcaccggcaacctgttactgctgttgtctat

SEQ ID NO: 35069 - protein, 73 aa, Zea mays
  misc_feature: Ceres CLONE 1414134-F
MAPRPRKRASRPKPRPGSRRGGGGGDDDPFFESEPKRRRGGRDEDIESEDSDDDGVGCVWGADLDEGWGRSGG

SEQ ID NO: 35070 - DNA, 727 bp, Zea mays
  misc_feature: Ceres CLONE 1414138-F
  misc_feature (371)..(371): n is a, c, t, g, unknown, or other
  misc_feature (462)..(462): n is a, c, t, g, unknown, or other
  misc_feature (493)..(493): n is a, c, t, g, unknown, or other
aagctggagctccccgcggtggcggccgctctagaactagtggatcccccgggctgcaggaattcgcacgagaccattacctagaacatcctaatcaaaaatagtttaatggttttctagtcgtccgtcctcctcggttctggctgccaaccccaagaactgccttgcctagtgcctactgcctagggaaggaccgaaggagaggtgcgcggctggtggcgtgcgagtggcagcggcgccgcgggactcttctcctcgccgctcgcctgctgggtgcgccatccctcgacggtgacaccgtgatattgctgtgaagttttgtggcacttcctgcatcccttatatggtattaacaataattttaattgtcntgggtgatccatttgagcaaatggaaggcaatgatgtaccccttggaaacatgttgcagggggtcccctatgaaagtttagacttacgtgncagctctatgcaaaattatgctccaaactcnagaaaacatatcttcagcagctcccagatggcacgtacttttcacatgtctatgaccagggctacagagcctgatgactttccccttgggtttcagttcaaagaacagggaaaagagtgatgaccaccacccacaacaccatagtcatcactcaagaactgcagaattgatggtgaggaaacatgttggggctgaagatgctactgatacccaagtggcaaaaggaagaagggt

SEQ ID NO: 35071 - DNA, 731 bp, Zea mays
  misc_feature: Ceres CLONE 1414142-F
  misc_feature: Encodes the peptide sequence at SEQ ID NO. 35072
aagctggagctccccgcggtggcggccgctctagaactagtggatcccccgggctgcaggaattcgcacgagaccattacctagaacatcctaatcgaaaaaaactaccgaagtctacttccattccttcctttctcctttcatatacccgcgtcgcccacgagcccgccgtgccgacagaggtgtggacctcgccggagcagaggctatggggccaccgcagccagccaggcccggcgtcatcaacatcgaggcctgcgcgcggccgatcgccgtcgaccaccgcatcagccttccctactacttccgcatcgcgggcagcctcctccgacaggctaatatatatcggaacgagagtaacttcctcgacctatatgtcatccttctgagatactcgagcttgctgtgtgaaacaattccgaggcatcgtgattaccatgccttcaagttaagagaaaaggcatttttttgataaacttgttgatgctatcaaagaacttgagacattgaagccagttgtgcagcggcagattgccgatcataatagaggaggtactgtggaatctaatatgaatagtctaaatggagacaatggtaccactcataggatagagcagcataactccaagttcttatactccaccgccattttgtaagcaaccctaatggagcatccgcaaaaatcctttcatgctggggaaaacaagtgggcaccattaccggaagtgccc

SEQ ID NO: 35072 - protein, 87 aa, Zea mays
  misc_feature: Ceres CLONE 1414142-F
  misc_feature: SWISSPROT Homolog: EC 3.1.2.15 Ubiquitin thiolesterase
MGPPQPARPGVINIEACARPIAVDHRISLPYYFRIAGSLLRQANIYRNESNFLDLYVILLRYSSLLCETIPRHRDYHAFKLREKAFF

SEQ ID NO: 35073 - DNA, 908 bp, Zea mays
  misc_feature: Ceres CLONE 1414143-F
  misc_feature (26)..(26): n is a, c, t, g, unknown, or other
  misc_feature (27)..(27): n is a, c, t, g, unknown, or other
  misc_feature (38)..(38): n is a, c, t, g, unknown, or other
cccccccctctcactgcccgacatcnncctgccttttnttcacaactggagctccccgcggtggcggccgctctttaatagtggatcccccgggctgcaggatttcgcacgagaccattacctagaacatcctaatcgaacaagcaatactcactcctagtcctggagtatagtcactactacccctagaagggaagcgcatccgctcgatacggggggtggcaggttggcgaggagacgaaaggctcggcgagcgagagcccaacgaccgtccagttccagttccagcggtccgagcgagatcgatcgcccctccgcaacgccgcaacaacagacgcggatcgcgggcaccacggagttcttctggaggtgccggagatcacgcgagtggtgttgccccttgacaacgaatacaaaaacaggccggcagggaggcgcctcccgtttcccgaacccgaacctacaaggcccatcgccatcttgctgctggccgcccccccccccacctgaaggagcggagaggcatttgccccggggccccttccatcctatcccgacgctccgccgctccccccctcccttgccaggaacgaacgtcgcgtcggccccccgactccaacataggccacgggccacccaacctcccctatggcataaccccacaccccgggcagggcccccctcgtggaaccccgaacacatggcatcacgcggatcacacggctccacgcaaacgtaccgcaggataaacccacagcagctctctcgtacggttatccattcggtcagcagtctcatcgacacaccaacacacgacgtagccccctccactcaccttttaagtcaccttctccagactatttagcatcgtcctgtcgcatgttcttacactcgcttcatacccgacg

SEQ ID NO: 35074 - DNA, 743 bp, Zea mays
  misc_feature: Ceres CLONE 1414147-F
  misc_feature: Encodes the peptide sequence at SEQ ID NO. 35075
  misc_feature (452)..(452): n is a, c, t, g, unknown, or other
  misc_feature (453)..(453): n is a, c, t, g, unknown, or other
  misc_feature (458)..(458): n is a, c, t, g, unknown, or other
  misc_feature (459)..(459): n is a, c, t, g, unknown, or other
  misc_feature (520)..(520): n is a, c, t, g, unknown, or other
  misc_feature (540)..(540): n is a, c, t, g, unknown, or other
aaagctggagctccccgcggtggcggccgctctagaactagtggatcccccgggctgcaggaattcgcacgagaccattacctagaacatcctaatcgaaaaagggcagagcagagctgagctgcctccaactccgacccacacccacggcacggcagtcggcagcagccagcgtcgagcgcagtgccctcttgtctgctgcctcctacctccccgcccgctgccccgcgcccagtctcactcacacgctcccacttctgagatggagccagattcggcgacgacgaggctcgcattgctggcgctgcttctcctggcggcgcccgcccgcccggtctcggcggctccggtggaggatggcctgctcagcaatggtgactttgagacggcaccagcccggcggttttgtaagatctgcgtctgttgctgagggtgcatcgtcaatccctggnntgacnnatcatgccacagtcgagctcattttcagcagccagcaccagggtggcatgatcctgattgntccacagggagaccatgctngtaagctaggggatgatgctaacgtttggcaggtggtggacgtcaaaaaggcctcgaactacgctggcaaattcagggctggcgggaattgggccaactgaaagccctgaacgcctcctggtagggggggggcccaaaagtgaacttaccgacgttgaaaaattaaagggtgggaacgctaccctttggtttttagggaaaga

SEQ ID NO: 35075 - protein, 94 aa, Zea mays
  misc_feature: Ceres CLONE 1414147-F
  misc_feature (33)..(33): Xaa is any aa, unknown, or other
  misc_feature (35)..(35): Xaa is any aa, unknown, or other
  misc_feature (55)..(55): Xaa is any aa, unknown, or other
  misc_feature (62)..(62): Xaa is any aa, unknown, or other
MACSAMVTLRRHQPGGFVRSASVAEGASSIPGXTXHATVELIFSSQHQGGMILIXPQGDHAXKLGDDANVWQVVDVKKASNYAGKFRAGGNWAN

SEQ ID NO: 35076 - DNA, 761 bp, Zea mays
  misc_feature: Ceres CLONE 1414148-F
  misc_feature: Translation starting site: 161
  misc_feature (518)..(518): n is a, c, t, g, unknown, or other
aaagctggagctccccgcggtggcggccgctctataactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagatattccagtgtttaccaacagagtttctcgtacgtaccgggcaaaatcagtgacagttccagatcacggagttgatgtgtgtcctttggaatacaatgagtatgtcccctgccatgatggagcctatataagcagcttgaagagcctggatacatctaggcatgaggatcttngaagtatttgtcctccatgggagaagcggttgctttgttttggtgccccctcccaatgactacaagataccattaagatggccaacaagcccagactactaatggggtagtaatgtccacccattcacttccttgctgagggcaaaggagggacagaacctgggtgcctcgaaaacggccaaacttttggtggctttcctgggaagggggccccccccttcaaacatgggggcattcacaaaa

SEQ ID NO: 35077 - DNA, 733 bp, Zea mays
  misc_feature: Ceres CLONE 1414151-F
  misc_feature: Encodes the peptide sequence at SEQ ID NO. 35078
  misc_feature (1)..(1): n is a, c, t, g, unknown, or other
  misc_feature (239)..(239): n is a, c, t, g, unknown, or other
  misc_feature (514)..(514): n is a, c, t, g, unknown, or other
  misc_feature (515)..(515): n is a, c, t, g, unknown, or other
naaagctggagctccccgcggtggcggccgctctagaactagtggatcccccgggctgcaggaattcgcacgagaccatacctagaacatcctaatcgaaaacttgctccatatcccatccatcacagctagctagcgtacagacgaataatctcttcttcacctcactagctaacaccagctagcagctcgatcgctctgtcctgcaataatggccgctcgctcctcctcccagcagntggtcgcggcggcggtcctggcagcggcgctgctgctgctggcggcgggggccgggacggcgtcggcggcggtgagctgcggcgaggtgacgtcgtcggtggcgcccgtgcctcgggtacgcgatggggcagggcggcgtcccccctccccgcgggtgttcttcacggggggggcgtctcctcaaaaacccgggggtttttgggggggggaaccggagggcccccctggaaatggccctcaaaaaaatgagggggccggttcgcggggggggggnnatgcgaagggcaagccgccacaattccccggaaggggggggttccccggggggggggcccttaacccccccgggggattgggccaaaaaaaatggggcctgggaaccccatggggggggcttccctccctgggaggggagcgaaccggggcaccacaaaaatggaagtcctccgcctaaaacaaaagggcccaaacacacgggggggaccggacccca

SEQ ID NO: 35078 - protein, 160 aa, Zea mays
  misc_feature: Ceres CLONE 1414151-F
  misc_feature (10)..(10): Xaa is any aa, unknown, or other
  misc_feature (102)..(102): Xaa is any aa, unknown, or other
MAARSSSQQXVAAAVLAAALLLLAAGAGTASAAVSCGEVTSSVAPVPRVRDGAGRRPPSPRVFFTGGASPQKPGGFWGGEPEGPPGNGPQKNEGAGSRGGGXAKGKPPQFPGRGGFPGGGALNPPGGLGQKKWGLGTPWGGLPSLGGERTGAPQKWKSSA

SEQ ID NO: 35079 - DNA, 734 bp, Zea mays
  misc_feature: Ceres CLONE 1414152-F
  misc_feature: Encodes the peptide sequence at SEQ ID NO. 35080
  misc_feature (734)..(734): n is a, c, t, g, unknown, or other
aaagctggagctccccgcggtggcggccgctctagaactagtggatcccccgggctgcaggaattcgcacgagaccattacctagaacatcctaatcgaaaagtgtctcttccccccaccactccgccaccggcgccgaagcagagcagccatggccggctccgagcagcgcgtcgtcgccgtcatcatggtcggcggccccaccaaagggacgcggttccggccgctgtcgctgaacgtgcccaagccgctcttccctatcgccggccagcccatggtgcaccaccccatctccgcctgcagccggatcccccacctggcacagatatacctcatcgggttctatgaggagcgggagttcgcgctctatgtctcgtctatctcccacgagctcaggatccctgtcaggtacctacgagaggataagcctcacgggtcagctggagggctctacagctttagagattacatcatggaagacagtccgtcacacatagttctgctgaattgcgacgtctggtctagctttcctcttccagacatgctagaggcccataaaaagtatgaagggatgggtactttactagtcaacaagggtttcgcagagtccggaaacccgtttcggggaggtggtaacttgttcctgaaacaatggaattgggtgccttaacggaaaagcccgaaaattttggggggaactcccaaaaattggggggaatatatattttcccccn

SEQ ID NO: 35080 - protein, 172 aa, Zea mays
  misc_feature: Ceres CLONE 1414152-F
  misc_feature (9)..(168): Pfam Name: NTP_transferase Pfam Description: Nucleotidyl transferase
  misc_feature: SWISSPROT Homolog: EC 2.7.7.13 Mannose-1-phosphate guanylyltransferase
MAGSEQRVVAVIMVGGPTKGTRFRPLSLNVPKPLFPIAGQPMVHHPISACSRIPHLAQIYLIGFYEEREFALYVSSISHELRIPVRYLREDKPHGSAGGLYSFRDYIMEDSPSHIVLLNCDVWSSFPLPDMLEAHKKYEGMGTLLVNKGFAESGNPFRGGGNLFLKQWNWVP

SEQ ID NO: 35081 - DNA, 724 bp, Zea mays
  misc_feature: Ceres CLONE 1414153-F
  misc_feature: Encodes the peptide sequence at SEQ ID NO. 35082
caaagctggagctccccgcggtggcggccgctctagaactagtggatcccccgggctgcaggaattcgcacgagaccattacctagaacatcctaatcgaaaagaaaaggctagccaagaaaacgactgggcgcacgaggcttctgtgttctgtgacttctgtccctatccacacgaccccgacattccatgggcgactccggcggaccccaccaccaccgcccttcgccgccgcctctgctggacgccggcaagcgacggcgcatccccaacgtccgcctcgctggctccgtcccgctcccttcccacctgccccacccgcgccgcgtccccattgcccccgccaccaggtcccgcaaacccctccaacttcagcataacagcaaccagcatgaccacccctccgcggagccacccaataccctcctaaaacccttcgtcgacagcggcgacgacgtcgtcttggccgccgcttttccccgcaaggtcagggccccggcttgagggactggtggtggggagctactgccacgatgtgctaatccggggcgggcgcatagtgggggagacgctcggcggggctgcggccttcgtgtccaacgtgctcgacgccgcttcgccccagggcgccgcgctcaacgagacatccccctttgtcgtggtggccaaggtgggtcacgaattcatctacgcccgcgcgccggggtccgcgcgcatccgcctc

SEQ ID NO: 35082 - protein, 104 aa, Zea mays; identical to SEQ ID NO: 24496
  misc_feature: Ceres CLONE 1414153-F

SEQ ID NO: 35083 - DNA, 823 bp, Zea mays
  misc_feature: Ceres CLONE 1414155-F
  misc_feature: Encodes the peptide sequence at SEQ ID NO. 35084
tccctccgcccccctttccccttcctcaaataaatcccggatttttcagagctggagctccccgcggtggcggccgctctagaactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacggcgcggcagtccatcttctactcctacaccaagagcatcatcaatggcttcgcggcgcaccttggagggagtcggtccgcgcagcagatccccggagcaccctgaaggtgatgcccgccgccctgcacaagcaagatgctcaaacctggcacaccacgcggtccctcggcgattcatggaccttggaatcccaacggacatcgatcctccctgggctccatatgggaaacaacgctaagctccgcaccaggacttcccccactccccagaccctcaaccagcggaatgctggccccgaagtcccaacagtttcccaatcacccacagcatacccaacatgacccaaccagtctgacaccgagctacatgtgcaggaacacccccgaacgacccggtagttccccttggaagccggtctat

SEQ ID NO: 35084 - protein, 112 aa, Zea mays
  misc_feature: Ceres CLONE 1414155-F
MATRWRRSLLWVAVVQFLTLCVAEHLVVEAYKKSYIVYLGSHAYGRDASAEEHARATQSHHHLLASILGGDDHHHHETARQSIFYSYTKSIINGFAAHLGGSRSAQQIPGAP

SEQ ID NO: 35085 - DNA, 674 bp, Zea mays
  misc_feature: Ceres CLONE 1414157-F
  misc_feature (446)..(446): n is a, c, t, g, unknown, or other
  misc_feature (449)..(449): n is a, c, t, g, unknown, or other
  misc_feature (574)..(574): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcaaaaaggacaccactcatcttcttctcccccgcctcgtttccatcgccaccaccctcttctcctgcggtcctcccccgtgccactcccacccccctcgcctccgcctccactggagctggcgccatggagaggctcctcctggccaaccctggcgggggcccccgggggcgcctccgtgcgaaagcggaatctccccgggaagcctctccgtccgggcctccgcgacggtgtagcggaccgcggcgggaacgatccccaaaacgggtggtgatcacgggaaagggggttggctctccttttcgggacgatgagacgctactacaccgcctgctagtcgggaagcggatnggntggggcctcaccggtttaagcttttaattatcccccccccttttgcggaaaaaggggggttctctcccacgggaaatcccggaaaaaaaacgccgctcctagtatggcccccaaaaagggattcnccgggggaaaaaagagtttccgagggccccgaaatccccacggttcaagctattgggaaaaannnnnnnntaaaaataaaaaaccgnccggggctgggga

SEQ ID NO: 35086 - DNA, 790 bp, Zea mays
  misc_feature: Ceres CLONE 1414167-F
  misc_feature: Encodes the peptide sequence at SEQ ID NO. 35087
  misc_feature (413)..(413): n is a, c, t, g, unknown, or other
  misc_feature (414)..(414): n is a, c, t, g, unknown, or other
  misc_feature (418)..(418): n is a, c, t, g, unknown, or other
  misc_feature (422)..(422): n is a, c, t, g, unknown, or other
  misc_feature (466)..(466): n is a, c, t, g, unknown, or other
atagctggagctccccgcggtggcggccgctctagaactagtggatcccccgggctgcaggaattcgcacgagaccattacctagaacatcctaatcgaaaaatctccaaattaagtcgccgagctctgaagaatctagctaggagcaggccgcctacgccatcggccgtccacagcaacatgtgctccggctcctggttctggagcagcagcggcagcggcaaggagcacccgtctcttgtcgtcgtcaacctcgagcggcagctaaagaagacgctggccgtcaggagaaggaggaggtaactagcgtgctctgttcgagtttctcaagattcctctgcccagcagcaacagtttccctgcaccacacacgcgccacacgtacgtacgcatgcatgcaggttgaggctganngagntgcnagacggaagaacaaaggccatggagatggtgaacctgaaactgnattctgaagaccgttgcatcatcccaaaaaaaccaaaggtccgggaaaagggccagggggctcccccggaggaactcccggttggtccaaaacctggccccaggaagggggcccgggcccaaacccaaaaagggaaaccccggggggtttttttttaaacccctggcccgccggccgggaaaaaaaaaaaaaaaaccccccaccccccccccgggggggggtggggccccttggggggaaaaaaaaaacccccggatacccctccccccaagagcccctttgtttggtcgcccccccagggggtggggggcccctcacccccaa

SEQ ID NO: 35087 - protein, 40 aa, Zea mays
  misc_feature: Ceres CLONE 1414167-F
MCSGSWFWSSSGSGKEHPSLVVVNLERQLKKTLAVRRRRR

SEQ ID NO: 35088 - DNA, 675 bp, Zea mays
  misc_feature: Ceres CLONE 1414169-F
agagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgccccagccgccgccgtcggcctcctcctggtggcgcgacatgcagcacccggctgcctacggcgcgtggcctccgtcccccgcggcgaggtggccgcccccggtatcgatggcgccggcagcgacgcagcaccaacaccagcacggcgggccgggcgacgaactcctcccgacggtctcttcgcctccaacgccacccgaaagggtcctttaccaaccactccggggtcccgggctcaaccctggaactcccccgggtggaaacttgaggccccccccccccttgcccgccccc

SEQ ID NO: 35089 - DNA, 756 bp, Zea mays
  misc_feature: Ceres CLONE 1414173-F
  misc_feature: Translation starting site: 196
  misc_feature (587)..(587): n is a, c, t, g, unknown, or other
  misc_feature (597)..(597): n is a, c, t, g, unknown, or other
  misc_feature (679)..(679): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaaaaaaaaagagccgacgtcactcctcccgatctgggcgcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcgtcactggcaccgtcgcccgcgacgccggcccaggtgtcacgatcagttttgttcttgctggagctgcgtgcgtgctcaatgccctgtgctatgctgaactggcgtctcggttccctgctgtggttgggggagcatacttgtacacgtacgcagcgttcaatgagatcaccgcctttctggntctcactcangtgatggtggataccatatcggcgcagcaagcattgctcgcagcttagcagctactttatcgagttcttggagctaatcccnngctctgaagggcaaattccaagctggggtagccatggggaggagttttttgggggtggtgtatcaattaacatacg

SEQ ID NO: 35090 - DNA, 750 bp, Zea mays
  misc_feature: Ceres CLONE 1414175-F
  misc_feature: Translation starting site: 209
  misc_feature: SWISSPROT Homolog: EC 3.6.3.14 H(+)-transporting two-sector ATPase
  misc_feature (339)..(339): n is a, c, t, g, unknown, or other
  misc_feature (346)..(346): n is a, c, t, g, unknown, or other
  misc_feature (378)..(378): n is a, c, t, g, unknown, or other
  misc_feature (408)..(408): n is a, c, t, g, unknown, or other
  misc_feature (413)..(413): n is a, c, t, g, unknown, or other
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggtctctggacctgtggttgtggctgatggaatgggtggtgctgccatgtatgaacttgntcgtgtncgacatgataacctcattgggggaaatatccngtctgaggcgattcagctaccatcaagttnatgangaaacagctggactgatgggtaaatgaccctggattgagaaacagaaagccttcttcagntgaattgggacctgggattcttggaaacatttttgacggttccagggagcccttaaaacccttcgttttaagcccggagagggggatttcccccggggggttccatccccgccccttgaaaaaagggtttgggggaatttcccccccaagcttggggggggggaagtcccccccgggggagactacccccccggttttttaaaacaatttgggggcccccggggtctttccccgggtttttggggaaaaaaaattctcttcccccgccgcccccccc

SEQ ID NO: 35091 - DNA, 632 bp, Zea mays
  misc_feature: Ceres CLONE 1414181-F
  misc_feature (310)..(310): n is a, c, t, g, unknown, or other
  misc_feature (431)..(431): n is a, c, t, g, unknown, or other
  misc_feature (435)..(435): n is a, c, t, g, unknown, or other
  misc_feature (436)..(436): n is a, c, t, g, unknown, or other
tggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggccgccgcctcccgcgtcgacgccatcgnccgagaatcgaaccccttaccgcccttcaagcccttgggggaaattccccccttccttttttcccccgaattttcaaagaaggggggggggacgcccccccggggggtttttttttttttncctnncccttttttttttcccacaaaaaaaacccctttttgtggggggggggcgggggcccaaaaaaaaaaaccccccccccccggggggggggggggaaaaaaacacgggggggggggggggggcccccccccccccccgcggggggaaaaaaaaaaaaaaacacttctcctccccccggggcccagaaaaaaaaaaaaa

SEQ ID NO: 35092 - DNA, 716 bp, Zea mays
  misc_feature: Ceres CLONE 1414185-F
  misc_feature: Encodes the peptide sequence at SEQ ID NO. 35093
  misc_feature (610)..(610): n is a, c, t, g, unknown, or other
  misc_feature (614)..(614): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
aaagctggagctccccgcggtggcggccgctctagaactagtggatcccccgggctgcaggaattcgcacgagaccattacctagaacatcctaatcgaaaagacaaccccagcgcacgaactccaaaatagcgagccgaagggggccacgagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatggtacgtggtgctgtggcatcaccaacatctactgcacctgcagccaacaagaaacctacactgctgctcctgccagttccccgcaaacagatgggntggnttgttgcaagtctggtactacggcgctgctgctacaggagggtggttgtgatgcccgtaacacannnnnnnnnnnnnnnnnnnnnnnnnnnnnnnnnnnnnn

SEQ ID NO: 35093 - protein, 139 aa, Zea mays
  misc_feature: Ceres CLONE 1414185-F
  misc_feature (22)..(90): Pfam Name: ubiquitin Pfam Description: Ubiquitin family
  misc_feature (119)..(119): Xaa is any aa, unknown, or other
MGGGDADAGGEPADAQATLHIRCTNASKFTVRADLGATVGAFKAIVADSCDVPAPQQRLIYKGRILKDEQTLASYGVETDHTIHMVRGAVASPTSTAPAANKKPTLLLLPVPRKQMGWXVASLVLRRCCYRRVVVMPVT

SEQ ID NO: 35094 - DNA, 748 bp, Zea mays
  misc_feature: Ceres CLONE 1414188-F
  misc_feature: Encodes the peptide sequence at SEQ ID NO. 35095
  misc_feature (603)..(603): n is a, c, t, g, unknown, or other
  misc_feature (660)..(660): n is a, c, t, g, unknown, or other
  misc_feature (704)..(704): n is a, c, t, g, unknown, or other
aaagctggagctccccgcggtggcggccgctctagaactagtggatcccccgggctgcaggaattcgcacgagaccattacctagaacatcctaatcgaaaaacaaatcaaatgattccttgcttgcccccctttccctccaaaattctcgctgcggccctcgtcttcctcctcttcttcttctgtaaagtgccaagtgccaactgcattctggcttacttggaacaccactccttgattccttcccattccaccagtctcatcttgcatagtgctagaacttatccatttgcttgctactgctcttgcccagcatgagcaaacggccgatgatgacaacgccggcgggcggagaagacggtgagccatccagcggcgctcgcggagccggtgcgccgccgccgtctcagccggtcggtaccggccgctacgcaagactgcagagcgccggcaccgggaccagtgccgccgacggcgaccggcccagacgtcatgtgacctatatggaaggccgttttgaagcggcggagcagccgccaaccgatgacggttacggtgccggggacactgccccgccccagacgcgcacgcaacgccccaggncgacctacacgcctgtgtcgcagaggagacgagagccggcgattgatgagcagccancgttgtacggagattacccgcgcccgggcagccctgtcgaaccngcggcgcgaaacgcaacgcgtccccagggtagcccgtgccggct

SEQ ID NO: 35095 - protein, 68 aa, Zea mays
  misc_feature: Ceres CLONE 1414188-F
  misc_feature (39)..(39): Xaa is any aa, unknown, or other
  misc_feature (54)..(54): Xaa is any aa, unknown, or other
MTVTVPGTLPRPRRARNAPGRPTRLCRRGDESRRLMSSXRCTEITRARAALSNXRRETQRVPRVARAG

SEQ ID NO: 35096 - DNA, 816 bp, Zea mays
  misc_feature: Ceres CLONE 1414193-F
  misc_feature (121)..(121): n is a, c, t, g, unknown, or other
  misc_feature (296)..(296): n is a, c, t, g, unknown, or other
  misc_feature (816)..(816): n is a, c, t, g, unknown, or other
tttttttttttttcctcccccccctttctttttgtttttacacaagtaaaactccaattggtgccggagcaccaaccaaaaaagaccgggggcagaaagccttccccacccggccgagggnggggggcggggcccggccttccataagaaacttagtggatcccccgggctgcaggaattcgcacgagaccattacctagaacatcctaatcgaaaatccatccccgcgacgacccaccacccacccctgcagtctgcagcatccccttccccactcccggctggtctgctgcggncaccccctgcgccgatccacctccgctgcttccctgcctcaaatattccgccgccttcgtggccttcgaccccgccacaaaagggcttccaaaaaccctcgaacccctttcactttcgggtttcggcccccgtttcaaattttttccctccccccccgggggcggggcccaaactccccaaaggggccaccacttccaaggggccccccccccaaaggcaaaaaaacggcgccgcggggcccccactctccccaaggaaaaagaaaggcccccccgcggggcccgggggagacctttgagggtcctcggggggggccgccacacaccccggcgcacaaaacacgccacaaaagaatgggtataattctgggggagaaataacctatcctctccgcacaacggatccccccccccgagaggggggcggaaagaaaatgtattaacccccccccctcccctctttaataagcacccccccccccggcgggtctaccatccacccgccacgggcgcgcggggn

SEQ ID NO: 35097 - DNA, 741 bp, Zea mays
  misc_feature: Ceres CLONE 1414198-F
  misc_feature: Encodes the peptide sequence at SEQ ID NO. 35098
aaagctggagctccccgcggtggcggccgctctagaactcgtggatcccccgggctgcaggaattcgcacgagaccattacctagaacatcctaatcgaaaaaattccggccacaccccccgctacgcctgtgctgccgcctccccttcctcttcgcttcccgtgcaagcttcaccgccgccatctcgtcctctcgtcgcgatgcttccccttccgcgccgcggttcctctatccccgccttccctgcccgctccggctcttgcacctgacccagtccgccaatctgttccccttttccgtacgagggaactatcgccggacatttcgattcagagttgatcggatcagcgtacgctgatgggtcgcgatgctgagaagacctctccgccggtgccatcgtcggaattggaacaggaagaagacgacgactgctacctaagcgatcaggaggacgatgccctagaagagtccgttctccatgtcctccgagacgagcacctcgaggactgccattgggtccgcctcatgcgtgatcaccaaaggatcccctctggcagcgcaaaaaggaggatcttaagaaaggggatggacctgctaaggttgaggggaacaccatggcccggacgctcctcatccaactaccgcttggaacgggaacaggaatttttgagcttcctccaaccgaagggaagggaataccctcttcccggaggctggaattcctccttcaagaaaccaaa

SEQ ID NO: 35098 - protein, 127 aa, Zea mays
  misc_feature: Ceres CLONE 1414198-F
MGRDAEKTSPPVPSSELEQEEDDDCYLSDQEDDALEESVLHVLRDEHLEDCHWVRLMRDHQRIPSGSAKRRILRKGMDLLRLRGTPWPGRSSSNYRLEREQEFLSFLQPKGREYPLPGGWNSSFKKP

SEQ ID NO: 35099 - DNA, 771 bp, Zea mays
  misc_feature: Ceres CLONE 1414205-F
  misc_feature: Encodes the peptide sequence at SEQ ID NO. 35100
  misc_feature (327)..(327): n is a, c, t, g, unknown, or other
  misc_feature (330)..(330): n is a, c, t, g, unknown, or other
  misc_feature (771)..(771): n is a, c, t, g, unknown, or other
aaagctggagctccccgcggtggcggccgctctagaactagtggatcccccgggctgcaggaattcgcacgagaccattacctagaacatcctaatctaaaaatccaacgacccacactgagacgtcccctccccgctccgtcctctctcctctgccgccgagacgacgcgatggcggggtccgccgccttgccgccgctcgccgccttcgcgtcgctccttaccgcgcggcgcttcgccgccgccaggtccaagctccggtccctgctcacgccgcgcctactggcggtgccgttcgcggacccctcgcgctcgtcgctcccgcgnggngcgccgccgcacgccgtgggcgggttccacgacttgctcctccggggggaacccggacccgggccgcgcgtgccccccggccaaaaggcctccaaccccccccggtgccccgcctgggagcctcaacccgggggtgggacaggtttctcggtgccctcccccccccgcggcggggggccctcgggaacccgggggccctcttggggaggggggtctttttttgggcccggggtccccccccccccttttcccggggggctgtttttttaaagggttttttaaaaggggggggggggggaaacaaccccccgccgtgttctaaaataaactccccccccccgggggaaaaaagagaaggggttagagaaaaccccctctgtgtggtgtgggttgtaagaaaaaaaaaagaggggcggggccccccaaaaataaaattaaaan

SEQ ID NO: 35100 - protein, 142 aa, Zea mays
  misc_feature: Ceres CLONE 1414205-F
MAGSAALPPLAAFASLLTARRFAAARSKLRSLLTPRLLAVPFADPSRSSLPRGAPPHAVGGFHDLLLRGEPGPGPRVPPGQKASNPPRCPAWEPQPGGGTGFSVPSPPRGGGPSGTRGPSWGGGSFFGPGVPPPPFPGGLFF

SEQ ID NO: 35101 - DNA, 734 bp, Zea mays
  misc_feature: Ceres CLONE 1414209-F
catagctggagctcaccgccgggggggccgcttctaaaactagggaatcccccgggctgaaggaatttcgcactagaccattacctaaaacatcctaatcgaaaaacaccccacatcacaacagctccctctgcatctccgcctcgccgccgaagtctgactggacaaacttcttcttcatctctctctcttcttccgctgccaccctcccagcaccgaggtaaagtaagcccacccagaaatctccggcccgctcccggacgacgcccattctcataattgcatcggatctatatagagtttacagcaacgagtacaaaataccttatgcaatgcaaaaacatgcgcttgcacggccaagagctactttgtgagaaacaaggaaggaaagcacgccatactcttcattctctgccacctcttgatgacttctacagatcaagagtacacgtatctccacctcgtgctttcgcacaatgggcctcgacgaggcggctcaaccgtcttccttagatcaccatctcggcggagacggatgaagacttcacaccctctcgacctctttgctgtctcaatttatatcttcactgtcaaggataagcaagtgacctccggtgtgcataccaccaccaccatacgtaccatacacaggcacagatggcagagcataaagggaacgctctcttgcacaagtatgagatggggaaattgcttgcgcaaagcacctttgccaa

SEQ ID NO: 35102 - DNA, 760 bp, Zea mays
  misc_feature: Ceres CLONE 1414212-F
  misc_feature (430)..(430): n is a, c, t, g, unknown, or other
  misc_feature (481)..(481): n is a, c, t, g, unknown, or other
  misc_feature (482)..(482): n is a, c, t, g, unknown, or other
  misc_feature (505)..(505): n is a, c, t, g, unknown, or other
aaagctggagctccccgcggtggcggccgctctagaactagtggatcccccgggctgcaggaattcgcacgagaccattacctagaacatcctaagcgaaaatatataatcgttttgcactaatattttgttaaattttttgtataccgttgcaacgcacgggcacctaactagtatgagactatgagtacatcaagtgcattcccttagaactcttgttgtgtaaaaatgtgtaacatgtcttggtacagagattaatttggtttgtgttttttagactgcaattatatctgggttctcagccttgccatggttggtcaagcccctctatgattttatcagttgattcaggtggttgattatatggtggttcagagagctcgaggtgaatcacagagtacatatagatctctccactccagtcactatngttggggaatcctcagcctttggaggaatcatgagtgcatacttcagtggnntctccagccacttatggcgtaangatttgtctttggtgttacagcaccttttgcaactgttcccgagtagcaaaaaaagaccactctgccaaactgggaagaaaataaaaagattttcccaaggcggaatctttcaaatctggaaaaagggattccgggggaaatcctttgaccaaaaactgggttcagttttccaatttccaagcatactacgggaaattccacctggatcgggggaaaactcttccccccagggaaaaaatttaagagggtttccc

SEQ ID NO: 35103 - DNA, 753 bp, Zea mays
  misc_feature: Ceres CLONE 1414214-F
  misc_feature: Encodes the peptide sequence at SEQ ID NO. 35104
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaaaccccggccgatcccgcacccctgactgtcagccgcgatccgctcttgtaggctccctccctctccgacccgcgtctccctcctcccactccactgctcctgttttgcgtgcagcggcggagcaggagagatggcgtcggaggccaaggacgtgggcatcctcgccatggacatctacttcccgcccaactgcgtgctccaggaagagttggaaacacatgatggcgtgagcaaagggaagtataccattgggcttgggcaggaaagtatggcattttgcactgaagttgaggatgttatttcgatgagcttgacagtggtgaagtccctccctgaaaaaatatacattgacccaatgtgcattggacgtttggaaagtggcagtgaaacagtaatagacaagagcaagtctataaagacatgcctgatgcagatatttgaggaaatctggcatactgatattgaaagaggtgactccctcgaatgcatggtatggntggaacagctgcattggtttaatttgggtaactgggttggaaagcaagtcatgggaatgtccccttatgcaacttgttgtttgcccaaaacagggcggtttacccttaaaggcccggttccccctattggggggggcggctgctatatgaaagt

SEQ ID NO: 35104 - protein, 173 aa, Zea mays
  misc_feature: Ceres CLONE 1414214-F
  misc_feature (4)..(164): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
  misc_feature (123)..(123): Xaa is any aa, unknown, or other
MASEAKDVGILAMDIYFPPNCVLQEELETHDGVSKGKYTIGLGQESMAFCTEVEDVISMSLTVVKSLPEKIYIDPMCIGRLESGSETVIDKSKSIKTCLMQIFEEIWHTDIERGDSLECMVWXEQLHWFNLGNWVGKQVMGMSPYATCCLPKTGRFTLKGPVPPIGGGGCYMK

SEQ ID NO: 35105 - DNA, 899 bp, Zea mays
  misc_feature: Ceres CLONE 1414217-F
  misc_feature (13)..(13): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (41)..(41): n is a, c, t, g, unknown, or other
tttttttcccccntttntnntnttttttccttttttgtctntctctcctcttacaagctggaactcaccgcggtggcggccgctctagaactagtgcatcccccgggctgcaggaattcgcacgagaccattacctagaacatcctaatcgaaaaaaacctaaccaagcctctgcggctcttctccgaatccaactcccccccgatccccaaaatcgaaccctaagtcgaaaccctaacctccggccttctcgatgtctggtcgtctctaccgtccacccccctgcggtggccaccccgatggtaggccgcctccgtgcttacccggttgtcctccatgaattccgcttgtgggggcggcgatagtgaggagggaaagaagtatggatctaaaaatgagacgtagtcgagttggctccaatcgaccacatgagagtgacggttgagatccggtggagccggatcggggagaaaaacgtacaaccaagcaacaccctcctcagacggcgaaccattccctccatacgcctaccatagtacgttaacggtccaaagcagacctcgcctaaggccgcaccttcacactccgcattgtcatgccccacgatgcgaccgggcacattggtggttgaggcggctaatactaccgctgacactcccctccttcgcccactatctaccccgctcccaggcgtacttccctacgcgctcgcgatacacctcccccgcacactcaataaaagcaaaggcggaagagagatcgtatagaccccacattccctcacacccactcagccgctttctctactctcgcataatccgcgttaatgcctgataaacacaaggaagcccgcacggacagccccgccgatggtccccggcgtttccaccaccaaatac

SEQ ID NO: 35106 - DNA, 595 bp, Zea mays
  misc_feature: Ceres CLONE 1414221-F
aaagctggagctccccgcggtggcggccgctctagaactagtggatcccccgggctgcaggaattcgcacgagaccattacctagaacatcctaatcaaaaatctgttcccctttccctcctgcgcacccgtcttctcctccccgcgtcaaaccccagcacaaaaagcaaccgcccgccgcctcctcgttcctctcccgaatcagccgtcgcggtgcctaaatccggccgatccccccctccgatcccgcgggtggcccgccgacaagaggcgggcgccctccgggggcctccccccccgatggaataaagaaaacttttaagggggagggggatcgaaaacctaaaggaagggggccccagagaaaaaatgcccggaaaataacctaaagggggttcccccccttaaaaagaagggggcttgggaaattttaaaaaaccccccccctgggtgggaaaaaaaaaccccccccaaaaaggggggggggggccccccccccccagttttttcccagaaaacccccccccccccccccaaaaaaaaaaataaagggggggccctctcttaaaaaggggggcccccccaccccccccgc

SEQ ID NO: 35107 - DNA, 637 bp, Zea mays
  misc_feature: Ceres CLONE 1414223-F
  misc_feature: Translation starting site: 303
  misc_feature (546)..(546): n is a, c, t, g, unknown, or other
aagctggagctccccgcggtggcggccgctctagaactagtggatcccccgggctgcaggaattcgcacgagaccattacctataacatcctaatcgaaaacgactcactctctctgaaaactaggaaccccactcccctcccgaaactaccgccgccgccgctgccgccgcgatccaggtctcccgccccgcctgagatctcgacctcttcactcctcgccgctactgctcgccctcccgaggatcctcgatatcagctctcaggttttcagcctgatcaaaccggggtacccagccgtgcatgactgcattggttcgggtcgccggaagagcagcttcgcggagcagggtcggtatagcaggggcggcggcaccccctcctgtcggcttgtccgtgcagcgccggagggcgttccagggcgtgagaatgtacacgcgtggcagcaagggcggacgaggcgctctggagtgcctgcaaggtctgcaccgtagcgtgaaacttcgcagtgcgccaggctgctgtccttcctcaaggcaaaggctancatgccgagggatggagggtccccgatacgggcaccagtggggggcagatgatctcttcctacctcgcgacgattcgcagcttgatgacgg

SEQ ID NO: 35108 - DNA, 666 bp, Zea mays
  misc_feature: Ceres CLONE 1414224-R
tcgaggtcgacggtatcgataagcttttttttttttttttttggaaatgactctcagtgctgatccgtggtgctcctattgctgaaaggatcaggagttccctgccctgagaattctgcttctcgaagataactggctcaatatgatcaaaaagagccctactgcctgttgctcaggtcgagcaatgtgctaactctttgagaaagggaaaaagaaagacaggatggattggaattgcctctccgtaagaggctggccttaacttaccatcgactaagagggggagaccatatggccaaagtgctctgagacaggctcagacgatggcttcaattatgatagctccaaccactcaacgaggcatgttctcgtcagatccggtgctccgacaaacccccccgagtgaaggtcttaggaccttgctcccgaacatctcctactccagcgagtacgccggcgactttcttcacctcgactacgtgaaagggcggggtatcctccaagatctcagcctctaacccgagatgccccttcctcccttgcttggacccctgcagcttcaccaggccttcttcgtttctacacattgaaccgctctggtctcagggttttgtcaccgctgtgacacctatcgccgacaccggccttctggttcattgaacgcaa

SEQ ID NO: 35109 - DNA, 783 bp, Zea mays
  misc_feature: Ceres CLONE 1414229-F
  misc_feature: Encodes the peptide sequence at SEQ ID NO. 35110
  misc_feature (783)..(783): n is a, c, t, g, unknown, or other
aaagctggagctccccgcggtggcggccgctctagaactagtggatcccccgggctgcaggaattcgcacgagaccattacctagaacatcctaatcgaaaaattccacgctgcctcggccggcacctacctcccccacttcgccgccggcgggtggagtcgggccggagcagccgctagctcgcctctgttaccccaaaaaagacaaaaaaaataaagagagagtaccaagcaagccgccggcagctcgggcagccatggggcacggcgtcagctgcgctcgcacgggcgacgagcacaactacttccgcgcggcgcaggtcggggacctcgacgccctggacgcgctcctcgccgccgacccctccctcgcccgccgcgccacgctctacgaccgtctctccgcgctgcacatcaccgccgccaatggccacctcgaggtgatgtccatgatcttgaatcacggggtaccgccggacgccgtgaaccggcacaaccagacgccgctgatgctcgcggcgatgcacggaaaaatcgactgcgcgcggaaacttcctgcaggccggggccaatatccctgattcaactcccctgcccgggggggacctgccttggaccaactcgtacataatttcggccaagttcaaatggcctggggggcccatcctccctgggggacccgaacgcccgcccggggggccgaatcagagggggttttccccccggtttcatccaacgctatagggaaaacaccgtcaggggcacacccccgctggaacctcn

SEQ ID NO: 35110 - protein, 107 aa, Zea mays
  misc_feature: Ceres CLONE 1414229-F
  misc_feature (46)..(78): Pfam Name: Ank Pfam Description: Ankyrin repeat
  misc_feature: SWISSPROT Homolog: EC 2.4.2.30 NAD(+) ADP-ribosyltransferase
MGHGVSCARTGDEHNYFRAAQVGDLDALDALLAADPSLARRATLYDRLSALHITAANGHLEVMSMILNHGVPPDAVNRHNQTPLMLAAMHGKIDCARKLPAGRGQYP

SEQ ID NO: 35111 - DNA, 637 bp, Zea mays
  misc_feature: Ceres CLONE 1414232-F
ggagctccccgcggtggcggccgctctagaactagtggatcccccgggctgcaggaattcgcacgagaccattacctagaacatcctaatcgaaaagttccaaaaagaaaaaagaaaaactcagccgccggccgctgcccctctcggctgcacgacgtccgtgagggcgtgccccctggccccgtcccttgtcgcctgcccgccggtgcccgcacaggctgccagtgccatactgccatccctccgtccggccgtctgcccaggctgcctgcccggcgccctggcctcccggtcgctggctctctgcccaggcgccaggccgcaggtccccacgccccagaccacccgccgaacagtccgctgcaggctgcaggccaccgtccctccagttcgccggtcagattattaaccattcagataccccagttccgcctagacgcgaatccttccgccattatgggggcaggggtgtccctgcccaagccaaaacaaggccgtggtttcggacccggttttgggaacccggttttaaccccctcccccctcaggaaaccccctggcacctaattacgggaaggtgtaaaacccctgtcccccagttcgggtccccaaggcccgaaaaaatttttggcccccc

SEQ ID NO: 35112 - DNA, 654 bp, Zea mays
  misc_feature: Ceres CLONE 1414235-F
  misc_feature (482)..(482): n is a, c, t, g, unknown, or other
  misc_feature (506)..(506): n is a, c, t, g, unknown, or other
  misc_feature (520)..(520): n is a, c, t, g, unknown, or other
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccggagatggcagcgnagttgcccgcgctgcggcgctcgntggcgacgtggcgnacctcaagtcggctggctcgacgcttcaagcatgaagggacctgccggtgttttcggcagacccgttcgtccccgtattgtccctaagggccaaattgggagggagcccttaccaggccaaattaaccccggtt

SEQ ID NO: 35113 - DNA, 656 bp, Zea mays
  misc_feature: Ceres CLONE 1414237-F
  misc_feature: Encodes the peptide sequence at SEQ ID NO. 35114
aaagctggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgccgccatgaaggcgctcaagtcgtacgccagacacctggactccaagtccatcccgcacttcctcgccgaggtctccgacaccaccgcggccggcgccggcgccggcagcggcatgcccaccggcggcgagttcaccatctcgctctaacgagtgctggcggcggtgcacgggcgcaacatcgtgccccagatcggcaacatcatggccaccatcatgggcacgctctcctccagcggggggtcctttcccgtcccacaggcctgctccaagggggggcccgccctccgggggaaaggaaatcgaccccccccggccccaaaaggggaaaaagccggcctc

SEQ ID NO: 35114 - protein, 73 aa, Zea mays
  misc_feature: Ceres CLONE 1414237-F
MGRSLSPLLRQELDNLDKDADSRRAAMKALKSYARHLDSKSIPHFLAEVSDTTAAGAGAGSGMPTGGEFTISL

SEQ ID NO: 35115 - DNA, 893 bp, Zea mays
  misc_feature: Ceres CLONE 1414238-F
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (868)..(868): n is a, c, t, g, unknown, or other
  misc_feature (893)..(893): n is a, c, t, g, unknown, or other
nggcccccnnnagccggncccccccccccccgcgcaagagacggattctcagagtggagctccccgcggtggcggccgctctagaactagtggatcccccgggctgcaggaattcgcacgagaccattacctagaacatcctaatcgaaaaagcctgcgctccccttctttcccgttcggctcacagcgaagaaggaagcctgttagggtttccacctcctttcccctcctctcatacagcgacgaccgagcgacacaccctcgatatccttcccctcggacccggaggcgagcatcagccccccgcgcctgcccccacacgcacccatccatattagaaaaccctcccacatgatctgaaggcggagtacgacccccgatctcaaggcacatagacaagagacacacaagacgcaccggctccaacttccacactcccctctaccccccaccacgcccctagcgcggttccacccctcgaaacccctctgagtgggggggtatacctctctttcacccacctttccgccgcgcccctccacactattaccccccacccacccgccgcctctcccccagccgcccacacaacccccacatcacccgcaccgccccaccgcaccctctgccccacgcctccctccccctagcccgcattcctgatcagtcagcctctcccaccgcatccccgaccgtcggataacaagcggagctcacaccacgccccacttttcttaacatcacctcaggccaccatctatcattatatctttgtaaatatgacccgccttaattttatatcgagctgaactgcgccgaaggaccatcccacgccgcccgcggcctcgcccccactgatagctacccnccccgccgcgacgcgaaggtccggn

SEQ ID NO: 35116 - DNA, 711 bp, Zea mays
  misc_feature: Ceres CLONE 1414239-F
  misc_feature (406)..(406): n is a, c, t, g, unknown, or other
aaagctggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggacgtacgctctgcctcactcctccgtctcttgcttcccttgcccgccgcggcgcgcggcgcccggcgcggaatcgcggcgggtgcatggtagaagcccgccgccggcgcccgacaggcaccagccgnccggcggcctaccggcagcggaggggagcaccgcaacctggtccgctctgcgtcgccgggggggttgcatggtaacaccccggcccggggccccaccaaattacccgaaagtaatgaccgggaattttttaaaaaagccccgcccccctggggggggggccaaatacctggaggatttctccaacgcccccccggtttggccccggcaataaaaaaaaaatgggggtgggtggaggccccccaaaaaaccccgcccccccctgttttcttgaggggttggggggggtgccccccaccacaatttc

SEQ ID NO: 35117 - DNA, 794 bp, Zea mays
  misc_feature: Ceres CLONE 1414243-F
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (45)..(45): n is a, c, t, g, unknown, or other
agaggaggagacccccccccaacacccccccccccccnnattntntttgtgtagtataacataactggagctccccgcggtggcggccgctctagaactagtggatcccccgggctgcaggaattcgcacgagaccattacctagaacatcctaatcgaaaagccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcagttcgccgctgaagcttctagtttccagcggttcccaccagtttggctaaaaaacttaattgttgctggaaccgtgagggtgccttttgggccgaaatttggccaggggtagctttttgggagggattttgggcaaggggtggaaaccccctttgggggggtgggaaaaatccaatgggctaattttttgggggcccatggaactttggttttttaaatggaaaacccaaattggggcggggcaaggggctccaaataaaatttttttgaggggcaacaataaaaaaggagtcccccctggggtggttctttttttaaaaaaaaattggcccaactttggggttctaaaagttctaaaaaaaccctctgtgtgtggggattaagacaaaaaatttttat

SEQ ID NO: 35118 - DNA, 642 bp, Zea mays
  misc_feature: Ceres CLONE 1414244-F
  misc_feature: Translation starting site: 187
  misc_feature (185)..(185): n is a, c, t, g, unknown, or other
  misc_feature (228)..(228): n is a, c, t, g, unknown, or other
  misc_feature (230)..(230): n is a, c, t, g, unknown, or other
  misc_feature (235)..(235): n is a, c, t, g, unknown, or other
  misc_feature (236)..(236): n is a, c, t, g, unknown, or other
  misc_feature (240)..(240): n is a, c, t, g, unknown, or other
  misc_feature (255)..(255): n is a, c, t, g, unknown, or other
  misc_feature (272)..(272): n is a, c, t, g, unknown, or other
aaagctggagctccccgcggtggcggccgctctataactagtggatcccccgggctgcaggaattcgcacgagaccattacctagaacatcctaatcgaaaaatcaactcgcaattccgcattcgttccaactcctgagcactttctcctcgtccccgacaagccaatcgaagccgagatacggncatggactccaccggcaccggagcagggggtaaggggaagaangnagcgnncggncgcaagggtcgcggncaaaggaaaaagtccgngtccaagtccgtgaaaggccgggctcagttccccgtcgggcgcatcggggggctaactgaaaaaagggcccctacccccaagggggtggggacctggggccccccgttaaccctcccgggtggccccaaaaaacccccccccttaagggtctgggagctcccgcgggaaaaggtccccaaggggcaaacaaaaaaaaactccctttttttccccccccccgggtttttttgggggctcccaaaaacaaaaaaaattttggaaaatttttgggggggggggggaccccccccccccccggggggggggggccccccaaaaaaaaccccccgtttttgggcggcccaaaaaaaaaagggggggggggagggg

SEQ ID NO: 35119 - DNA, 651 bp, Zea mays
  misc_feature: Ceres CLONE 1414245-F
caaagctggagctccccgcggtggcggccgctctagaactagtggatcccccgggctgcaggaattcgcacgagaccattacctagaacatcctaatcgaaaagcgaccgcgactcggatcggatctctctcctgtgtagagccatgctgtgctgcgctggtagtagcagcagcagtagcaatgagtagtccagtccacagctccaagaacacgtggccgtcctttccttgcctctccctatcggtattcggtaacgcagtgagaggacgtcaccgtctttatccatggcctgtcgcttgtagcatcgctgctcggatggtccctctgctctatccataccccttgagcagggtggtgatcaagctgaactcatgcgaacctcgatttcttccgaccggcggttttgtttctgtccgcttctgaaggatttctcccctttccttcttgcctcactccagtaagatctcactgctcgggcatttgcacgaaggccgtgggtcgacgtggagagttcagtgcattggggagtaacaaaggccagtggtaatggcgaaagtatggatgcctaccaggggggctggtctcgcctcgcccagcgatggacctcgagatccggaggcggcctgaggcccccaaaatagatttccggg

SEQ ID NO: 35120 - DNA, 664 bp, Zea mays
  misc_feature: Ceres CLONE 1414246-F
  misc_feature (189)..(189): n is a, c, t, g, unknown, or other
  misc_feature (190)..(190): n is a, c, t, g, unknown, or other
  misc_feature (230)..(230): n is a, c, t, g, unknown, or other
  misc_feature (239)..(239): n is a, c, t, g, unknown, or other
  misc_feature (279)..(279): n is a, c, t, g, unknown, or other
  misc_feature (287)..(287): n is a, c, t, g, unknown, or other
  misc_feature (288)..(288): n is a, c, t, g, unknown, or other
  misc_feature (295)..(295): n is a, c, t, g, unknown, or other
agagctggagctccccgcggtggcggccgctctagaactagtggatcccccgggctgcaggaattcgcacgagaccattacctagaacatcctaatcgaaaaagcaaagtaggaatggcgtcggcgagcatgctcgcgcgctcccttctccgcaccccagaccctacccaaacgagccacccgaaccgnnccggagcgccgctgtcgtctccttcccccgccgccaccgncgcctgtcngtgcgcgcctcccgtctcacgggctccccttccccaccgncacagccnngcggggnggctggcggcgtgcccaaacactgcttccggggcggggccgatgcctacctgtactgcaagggaatgcgggtggaagaaccccatgacgggtggcgagggcaaccccctcaacctttaaaggaaggcccaagatcctccgcaaaccccccgcggtttaccgggagggtccccccggggggtcccgcttccttcatggggggatggccggggaaggggaaaaaaaaacccccccccggggtaaaccggccctggggggagattttgggggggcgcgccccctttttcccccagggggaaaaaagatctcccctccccccccccccgggggggggaatttcacccccccccccggggggggtttttttaga

SEQ ID NO: 35121 - DNA, 651 bp, Zea mays
  misc_feature: Ceres CLONE 1414247-F
  misc_feature: SWISSPROT Homolog: EC 2.4.1.119 Dolichyl-diphosphooligosaccharide--protein glycotransferase
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (243)..(243): n is a, c, t, g, unknown, or other
  misc_feature (279)..(279): n is a, c, t, g, unknown, or other
aaagctggagctccccgcggtggcggacgctctatcaatagtggatcccccgggctgcaggaattcgcacgagaccattacctagaacatcctaatcgaaaaaaaaccccccctgccccagacgtcgcgcgcatgaaatgaaaccctagtgagtagtgaccctgtccggatcactgcgtggcgccgccatggcaccctccgctctggccctccctccgnnngcgctcggtcactgcggctcangacgaagcagcaggagctactgctccgcgtctcggngctggggctcatctacgttcttcgcttcgccggaccgccttcttctcggtcttccggtaagagtttatgatcccacgagtcgacccctactttaattacgggaccaggtttttcctcaccgaaaaaggttttaacaagtttgggaattggtcaaattccaaaagttggaaccccctcggggggggtccctcgggggaatttttttccccggtttctttggggaccccgcggggttttttccacccctctccccccgggggttttcccccttgttgtaacaaaccgaggggggtgtgggggtccccccccgggctttttttttttgccgaaaaaaaaaacatcttttggggaaaaaaattttttgggcgggag

SEQ ID NO: 35122 - DNA, 688 bp, Zea mays
  misc_feature: Ceres CLONE 1414248-F
  misc_feature: Encodes the peptide sequence at SEQ ID NO. 35123
aaagctggagctccccgcggtggcggccgctctagaactagtggatcccccgggctgcaggaattcgcacgagaccattacctagaacatcctaatcgaaaactggttaatcccccctcgccacgactcgcagccatcccttcacattatccgcgcgcgcgcgagcgagcggacgtagcgtgtgggtagcgtcgccgtgcggacggtctcttggtgccggtgcgggccgcgtgacggtgcgtgtgccgcccgcggggaggaggtcgttcggttggttggccctcggcgacgatggcggtccacggcggagaggcggtctccgtcgcgctcctcttctccctcgctttcttctgcgctcgcctcctgctcgaccgcctcggtctacaagccattagcagtctaccttttcaacaccaaagcttctaaggtgatgaaataatggaggccagggcaagcaaaaattgccaagttctcagagtccatttggaaaacttacctactatgcttctgttcaagcatgggtcctcatgataataaaggaaggaccattgctccttggatatggaggaatacttttgaggggtggccgaaccaacccatcggggcttccttggagggctttccaaagggggccgggggggatttaatatctttagcctgggggcccttggtggttggggaaaaccgc

SEQ ID NO: 35123 - protein, 57 aa, Zea mays
  misc_feature: Ceres CLONE 1414248-F
MGPHDNKGRTIAPWIWRNTFEGWPNQPIGASLEGFPKGAGGDLISLAWGPLVVGENR

SEQ ID NO: 35124 - DNA, 690 bp, Zea mays
  misc_feature: Ceres CLONE 1414249-F
  misc_feature: Translation starting site: 160
  misc_feature: SWISSPROT Homolog: EC 2.5.1.8 tRNA isopentenyltransferase
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaacattgaatttggccgagtaacagaaccgtgtctgtttttaattcctgacggttagagatggcccacccctccgccgccgccgtatcctccacggcgctcgctgcaaaccctagctctggcgccagcgaggaaggaggcgcccgctctccgccgtcgccgtctcagagggggcgggccaaggtggtgatcgttatgggcgccacgggcgccggcaagtcgcggctggccgtcgacctcgcggcccacttcgccggcgtcgaggtggtcagcgccgactccatgcagctctaccngcggcctcgaagtcctcaccaacaaggctcccctcccacgagcagaacggtgttcctcatcatctacttagcgtgattgatccctctgtcgagttcacttgccgtgatttccgcgaccgtgccctgccgattatacaggaaatagtgggaccgcggtggcgtccccttgtggttgtcggcggcacaaacttctacatccagcctctcgttagtccattcctcttggatgatatggcagaaagaaatgcagggctgtacctctgagagatcacatagatgacggccttaccgatga

SEQ ID NO: 35125 - DNA, 697 bp, Zea mays
  misc_feature: Ceres CLONE 1414252-F
  misc_feature: Encodes the peptide sequence at SEQ ID NO. 35126
cgctcttaactagtggatcccccgggctgcaggaattcgcacgagaccattacctagaacatcctaatcgaaaaatatccccttctccgtcctcccgcctgccgccatgtcttcgccttcgccctcgccgccggcgccggcggaagaggagggccgggcgccgaccaagtacgtgctgatcaccggcggcgtcgtcagcggcctcggcaagggcgtcaccgccagcagcatcggcgtcgtcctcaaggcctgcgggctccgcgtcacttgcatcaagatcgatccatacttgaacacagatgctggtacaatgtccccctttgagcatggcgaggtgtttggtcttgatgatgggggagagggtgacttggatttggggaaatatgagcggttcatagatgttactctgacaagggataacaactttaacactggaaaagattaccaagcctgtcattgagaaggaaaaaagggtggatattttggaaaaaacggaccgggttttcccccctggccctggaggaaaaaaaaaggggggaaacaggcaggggccttcgggtcccgggggagggggcaaacaccccccccctttgagggtttggggttatttaaatagggggggacctctttaagggggatattttgtcgcgccggtcccctcttctttggaggtttttgcgcccacatttttcttttt

SEQ ID NO: 35126 - protein, 117 aa, Zea mays
  misc_feature: Ceres CLONE 1414252-F
  misc_feature (20)..(117): Pfam Name: CTP_synth_N Pfam Description: CTP synthase N-terminus
  misc_feature: SWISSPROT Homolog: EC 6.3.4.2 CTP synthase
MSSPSPSPPAPAEEEGRAPTKYVLITGGVVSGLGKGVTASSIGVVLKACGLRVTCIKIDPYLNTDAGTMSPFEHGEVFGLDDGGEGDLDLGKYERFIDVTLTRDNNFNTGKDYQACH

SEQ ID NO: 35127 - DNA, 748 bp, Zea mays
  misc_feature: Ceres CLONE 1414253-F
  misc_feature: Encodes the peptide sequence at SEQ ID NO. 35128
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (36)..(36): n is a, c, t, g, unknown, or other
nnnnnnnnnccccccccccnnnnccccccccccccnccccccccggcccaggtcaaaactggtgctccccgcggtggcggccgctctagaactagtggatcccccgggctgcaggaattcgcacgagaccattacctagaacatcctaatcgaaaaacaaaccctcgtctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatcttcctcagggagctcatctccaactcctccggatgccttgggacaaagatcagggtttgaagagttttgaacggaccaagaccaaagctggattggacaggcccagagctggttcatcccaaattgtcccccgaacaaggggcccaacaaacacggctgaacaaattcttcgacaggcgggctttggggatgacccaagtgcaaaccttgggggaaaaaaccctgggaacccttggggggggggccaagggaccaaaaaggaatttcaagggggggggacctttggctgcttggggcgctaaaatggggccccaataaaatggggcccgggtttggggggggccggtttttttaaaaccgggggcccaaaactttggggtcggaaaaaaaaagaggtttttctttcccg

SEQ ID NO: 35128 - protein, 50 aa, Zea mays
  misc_feature: Ceres CLONE 1414253-F
MASETETFAFQAEINQLLSLIINTFYSNKEIFLRELISNSSGCLGTKIRV

SEQ ID NO: 35129 - DNA, 763 bp, Zea mays
  misc_feature: Ceres CLONE 1414256-F
  misc_feature: Encodes the peptide sequence at SEQ ID NO. 35130
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (32)..(32): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nggggnnccccnnttccnntttttccccnttngttttggcccnnnnnccaagctggagctccaccgcggtggcggccgctctacaactagtggatcccccgggctgcaggaattcgcacgagaccattacctagaacatcctaatcgaaaaaacccggctgtgctgtctcgtcgccttcctcccctcctgccggctgctgccgccgccagccgctgcaggcacgcttgccctctgctccctgtccatccactcatcattccccgtcatccaccaattcacaacccaaaaccctaaacccatttacctcaacgccaccgccgccgccgcgatgcagtccatggcgcccacctctccctcactcccggtggcaggccccgttccccgccgccgcctccagcgcgtccgcgccgccgcggtctccgacgagcccaaactcaacaagtacagcgcgcgcatcacggagcccaagtcgaagggcgcctcgcaggccgtgctctacggggttggccttcaccgacggccgacctccgcaagccggaggggtggcgtcctctttcgggggggtaactaaagggaacacccggaaacatgcgcctggctccgcctcgcctgaggcccacccgcgacggggccccgaggaggcccgctatgggcccactttccgaattccacaaccgtcgggggttaagcggacgcccatctcccatggggcaccccgggggcatggtgcttacaggccttccagacccgggggaacttctg

SEQ ID NO: 35130 - protein, 80 aa, Zea mays
  misc_feature: Ceres CLONE 1414256-F
  misc_feature: SWISSPROT Homolog: EC 4.2.1.9 Dihydroxy-acid dehydratase
MQSMAPTSPSLPVAGPVPRRRLQRVRAAAVSDEPKLNKYSARITEPKSKGASQAVLYGVGLHRRPTSASRRGGVLFRGGN

SEQ ID NO: 35131 - DNA, 634 bp, Zea mays
  misc_feature: Ceres CLONE 1414261-F
  misc_feature: Encodes the peptide sequence at SEQ ID NO. 35132
  misc_feature (335)..(335): n is a, c, t, g, unknown, or other
  misc_feature (354)..(354): n is a, c, t, g, unknown, or other
aaagtggagctccccgcggtggcggccgctctagaactagtggatcccccgggctgcaggaattcgcacgagaccattacctagaacatcctaatcgaaagagcctcgcaggagggagaggggggagagcggaggagaaaccacctttctttccgttccagacaagctcccagctttgaccgccgccgccgccgccgctgtgtgtgtgtgctcccttagtagttagtccctgtcgcgtcccggatcggagctcccctccgtgcacgggacacccgcggtccgggcgtctccactccccccccggatcgatcagctccgcctcccgcagataggcnagcaatggagtggctggcntttctgcatggagacacaaagagaagggatcagtcacttagtcggcctctctacggtccatgagcaccacatcaacggagcgcgatggccgctccgggtccaaattcaccctcctggattgtttcgacatgagggccgagtccattaagggggaccagtaccccggtttcctggagcgcccgttaaccgggggggggctccctttggtgaaatgaaaaggggaccccgaaattagggggtgttctatggggggggagggggggtttggcgtggggaaagg

SEQ ID NO: 35132 - protein, 51 aa, Zea mays
  misc_feature: Ceres CLONE 1414261-F
MSTTSTERDGRSGSKFTLLDCFDMRAESIKGDQYPGFLERPLTGGGLPLVK

SEQ ID NO: 35133 - DNA, 626 bp, Zea mays
  misc_feature: Ceres CLONE 1414266-F
  misc_feature: Encodes the peptide sequence at SEQ ID NO. 35134
aagctggagctccccgcggtggcggccgctctagaactagtggatcccccgggctgcaggaattcgcacgagaccattacctagaacatcctaatcgaaaaatgaaatgaaaccctagtgagtagtgaccctgtccggatcactgcgtggcgccgccatggcaccctccgctctggcctccctcccggcgccgctccggtcactgcggctcaagacgaagcagcaggagctactgctccgcgtctcggcgctggcgctcatctacgttctcgccttcgccgtccgcctcttctccgtcctccgctacgagtctatgatccacgagttcgacccctacttcaattaccgcaccacgctcttcctcaccgagaacggctttagcgagttctggaactggttcgattccgagagctggtacccgctcgggcgcgtcgtcggggggactctctttccgggtctcatggtgacccgccgggttggttcgcctcctccgggggggttttcccctcgtgtgacaaaaccccgggaggggtgggggcctccccccggcgtttttttttgtgggcaaaaaaaccaatttttggggcaaaaaaaattttttgcgccaaaaaaaattggaaaccccg

SEQ ID NO: 35134 - protein, 156 aa, Zea mays
  misc_feature: Ceres CLONE 1414266-F
  misc_feature: SWISSPROT Homolog: EC 2.4.1.119 Dolichyl-diphosphooligosaccharide--protein glycotransferase
MAPSALASLPAPLRSLRLKTKQQELLLRVSALALIYVLAFAVRLFSVLRYESMIHEFDPYFNYRTTLFLTENGFSEFWNWFDSESWYPLGRVVGGTLFPGLMVTRRVGSPPPGGFSPRVTKPREGWGPPPGVFFCGQKNQFLGQKKFFAPKKIGNP

SEQ ID NO: 35135 - DNA, 708 bp, Zea mays
  misc_feature: Ceres CLONE 1414268-F
  misc_feature: Translation starting site: 176
  misc_feature (293)..(293): n is a, c, t, g, unknown, or other
aagctggagctccccgcggtggcggccgctctagaactagtggatcccccgggctgcaggaattcgcacgagaccattacctagaacatcctaatcgaaaaagaatcttctgccactgcccttccatctcgtcccttagctacaagtcatctcgccgcaaccggaacccgcagccatggggacggaggcggagcagccggacatggacagccaccgaaacgacggcgtcgtggtggtgccagcgccgcgcccgcgtaaggggctcgcctcctgggcgcttgacctgctcgagntcctcgccgtgcgcctcggccacgacaagaccaagccgctccactggctctccggcaacttcgcccccgtcgtcgaggagacccccgcggccccaaacttagcgtccgcggacacctcccggagtgcttgaatgaaagagttgtcagggttgggcctaatccgaattttgctctgttgcggggtaccctggtttgatggaaaacgggagaatcctgccatgggctattagggtggaaaaactccctattgttcaaaaattgtgaaaaatgcccccctccaaaaaaaggaggtattttgggggaacaagttttataaaaattggaaccccaaaggggttttttttgggtgtgtttgggccccaaaggggcccactttcggaaaaaaaatcaaagcccggggaattttccccagggg

SEQ ID NO: 35136 - DNA, 668 bp, Zea mays
  misc_feature: Ceres CLONE 1414269-F
  misc_feature: Encodes the peptide sequence at SEQ ID NO. 35137
  misc_feature (486)..(486): n is a, c, t, g, unknown, or other
  misc_feature (492)..(492): n is a, c, t, g, unknown, or other
  misc_feature (554)..(554): n is a, c, t, g, unknown, or other
  misc_feature (619)..(619): n is a, c, t, g, unknown, or other
  misc_feature (624)..(624): n is a, c, t, g, unknown, or other
  misc_feature (668)..(668): n is a, c, t, g, unknown, or other
aagctggagctccccgcggtggcggccgctctagaactagtggatcccccgggctgcaggaattcgcacgagaccattacctagaacatcctaatcaaaaaattaatttccagggatgcacgcaggcaagtttaatttggaggatcaatggtagctagctagagctactagagacatacatggcggatcctctggtgcgagcgcgacccaaaaggaagaaggtcttagcggactacttggtgcgactccgatggattcctgccctcttcgtggcccttccaatatctgcgctgatctacctgagcgtcttcctggggaacacgtggtccgccatgaaatccgagaagcgtcgacagaaggaacaccaggagaacgtaaagaggctgagagggtcgtgaagcgtctcagggagagggatccgaagagggacggcctcgtctgcaccgcgaggaagccatggggtggtcgtgggcatgcgcaacgtgnactacnaagcgcgcagacgcttcgaggtcgacctctcccgcgtgagaacatcctcgagatcgacgcgnagaagatggtcgccagggtgaagtctctcgtcagcatggcccagataaccaggctacctgccccnatganctctcgctcgccgtggctcctggagtggacgaccttaccgtcgn

SEQ ID NO: 35137 - protein, 72 aa, Zea mays
  misc_feature: Ceres CLONE 1414269-F
MADPLVRARPKRKKVLADYLVRLRWIPALFVALPISALIYLSVFLGNTWSAMKSEKRRQKEHQENVKRLRGS

SEQ ID NO: 35138 - DNA, 668 bp, Zea mays
  misc_feature: Ceres CLONE 1414275-F
  misc_feature: Encodes the peptide sequence at SEQ ID NO. 35139
tggagctccccgcggtggcggccgctctagaactagtggatcccccgggctgcaggaattcgcacgagaccattacctagaacatcctaatcaaaaaatgaaatgaaaccctattagagtaacgaccctgttgggatcactgcgtgacgccgccatggcaccctccgctctggcctccctcccggggccgttccggtcactgtggctcaagacgaatcattaggagctactgctccgcgtctctgggctgtcgttcatctacgttctcgccttcgtcgtccgcctcttctccgacctccggtacgagtctatgatacacgagttctaccactactacagttaccgcaccacgctcttcctcaccgagaacggatttagagagctctggaactggttcgattccgacagctggtacccgctccggagcgtctgcggggcgactctcttcccgggtttcatggtgaccgccgcgctgctcgcctcctccgcgcgctgctcctcgatgtccacatccgggaggtctgcgttctcaccgcgcctttcttcgccgtcaacaccattctcgtagcctacgcctttggccgctagatctgggactccggggaggtgatcgtcaccgccgcgttcatcgccaccgtccctgagtaaatttcccgctccgtctgggg

SEQ ID NO: 35139 - protein, 85 aa, Zea mays
  misc_feature: Ceres CLONE 1414275-F
  misc_feature: SWISSPROT Homolog: EC 2.4.1.119 Dolichyl-diphosphooligosaccharide--protein glycotransferase
MIHEFYHYYSYRTTLFLTENGFRELWNWFDSDSWYPLRSVCGATLFPGFMVTAALLASSARCSSMSTSGRSAFSPRLSSPSTPFS

SEQ ID NO: 35140 - DNA, 677 bp, Zea mays
  misc_feature: Ceres CLONE 1414278-F
  misc_feature: Encodes the peptide sequence at SEQ ID NO. 35141
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccccgggtgctgggcggcggcagctgcatcaacgccgggcttctacacgcggggcagcgacaactacgtgcggggcgccggggggaacctggcgcccccggagcgccccaccggtggctggaggacccggtggctttccaacccgaactggggccctggaaggccccttn

SEQ ID NO: 35141 - protein, 176 aa, Zea mays
  misc_feature: Ceres CLONE 1414278-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSEDGVINSRPRVLGGGSCINAGLLHAGQRQLRAGRRGEPGAPGAPHRWLEDPVAFQPELGPWKAP

SEQ ID NO: 35142 - DNA, 696 bp, Zea mays
  misc_feature: Ceres CLONE 1414284-R
  misc_feature: Pfam Name: DUF295 Pfam Description: Protein of unknown function (DUF295)
  misc_feature (563)..(563): n is a, c, t, g, unknown, or other
  misc_feature (696)..(696): n is a, c, t, g, unknown, or other
ccaattgggtaccgggccccccctcgaggtcgacggtatcgataagcttttttttttttttttttataaagatgtcataaactggcaaccttttctgcacatttcacatagagtagcacaaagtacagaatagttggaatgctagacgcaacaaacagaacacatctgggtgccgtttggttcaaatatgcgaaccaaacagtgcatacattttcagttactatctcaagggagaagccaagctggaggagagttgtaagaaggaacccgctccgggaagtagaattcgacgtgggaaggcagcagcccttccggcgaccacctaccgatgtcgttgcaagggtactgcctctcattgactccgccgaacatcatctcggcgtcgtcgtagaagctcctatcgtccaagaagaagatgctgtccttgaaccccgggtactgactcacctcgtatgacctggagcatcctcgccccaagaacagcatccggccacacaatgcaacctcctcgaaccggcaggtcttagactttagaatcacccggaatactttgaacgacgaantcggcgcgtgatggtgggcagcgagcctgacgaccaccagcagctcccccgcggatacccacgagtagcgagcgcggacgaactgctcgtcagtgcaccacgcttcctggaagcgcattaactctaaaagcgn

SEQ ID NO: 35143 - DNA, 685 bp, Zea mays
  misc_feature: Ceres CLONE 1414284-F
  misc_feature: Encodes the peptide sequence at SEQ ID NO. 35144
aaagctggagctccccgcggtggcggccgctctagaactagtggatcccccgggctgcaggaattcgcacgagaccattacctagaacatcctaatcgaaaaccgactaggtaccgacacacgaattcccgatcccgatggggacgtcgtcaccgtacaaccgtacgtccggcgagccctccgatgcgtcgagtctcgcatgcgtaccgttcgaggcgaccgtgactagtatggagatccctcgtcgcgcgcttccctcccctcccggactcctcaagtttccttgctggagtgtccgacctccatctccgctacttcggtcacagccggccccagcgtggcaggcgctccggtgtacctctcgctctcagcctggagaggcgacactctgctcggattgctgatgagatgcccacagcctttgtgatcttagatgatgttgtgaaacacaccctgagtagtttgcacagtattcacaaaagcttactattttgtacggtctggggtggcggaacaaatgctcagacagtgtactttatgatatctgagagaggtccaaggacctttgttgatgcatcatatcaaacactcactagactcgagagcaatggacgccctgtccgatacattttgcattctgcatctgatatgtggacgacaaaactcgctggcctgactagtatgc

SEQ ID NO: 35144 - protein, 92 aa, Zea mays
  misc_feature: Ceres CLONE 1414284-F
MPTAFVILDDVVKHTLSSLHSIHKSLLFCTVWGGGTNAQTVYFMISERGPRTFVDASYQTLTRLESNGRPVRYILHSASDMWTTKLAGLTSM

SEQ ID NO: 35145 - DNA, 680 bp, Zea mays
  misc_feature: Ceres CLONE 1414287-F
aaagctggagctccccgcggtggcggccgctctagaactagtggatcccccgggctgcaggaattcgcacgagaccattacctagaacatcctaatcgaaaagacgcccatgaggggcctgatctaatgtagcgttaggagaaagcctactgttccatctctttcttggagtacgagggcacgaaggcctaaccccctcgcccccaccagattcggggaattcgcgcctcatccgatcgtcaccggccgccgaagagcaagaaacagcggccgggttaggactctggaggatacggcggctcggcggattcaggaagtgaggatattttcttggatttctgtgtcttgattgaggagaggatctcgtattagctactgcgttattcactgcatgttggcaatgcggtcagaagagtgggagctctatccttcttccgacataggttcgcaggtcatagaatacagaacctgtgtctgaagacggtgatgacgatcagaatggggatgtggcagtgtccgctggatggtgctctccctgatgatcttctggagaaagctcttttccttcgtgcctgttgcaagtatcataagaactggggcctttttgcaaaagggggaatgaaaatgtgccatgcccggaggcacgcatggcacaaaataatggcttcagaaagcggggg

SEQ ID NO: 35146 - DNA, 682 bp, Zea mays
  misc_feature: Ceres CLONE 1414289-F
  misc_feature: Encodes the peptide sequence at SEQ ID NO. 35147
  misc_feature (415)..(415): n is a, c, t, g, unknown, or other
  misc_feature (520)..(520): n is a, c, t, g, unknown, or other
  misc_feature (531)..(531): n is a, c, t, g, unknown, or other
gctctagaactagtggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgaagacgcgtagctcgagggttcgtgatttctcgccgatcggttcgggaactggtaagctatggatctctcgcggnccgcatcgtcagacctctcgctcgggctgcactctcatgcccacgcccacgctcgcgtgcatgcggcagccgcgccgctgcgcctggtcgacgacgcgaagccgnagcgcctcgtnggccgggaggccgaacgcgagagggacgacggggaacggggcgaacagcacttctccttcctcgggcactccctctgcgtcagcgcccgcgccgcgcgtcaacgggggtggggggcggggggtggaaaaaacttcttcctgctcgtccccg

SEQ ID NO: 35147 - protein, 94 aa, Zea mays
  misc_feature: Ceres CLONE 1414289-F
  misc_feature (6)..(6): Xaa is any aa, unknown, or other
  misc_feature (41)..(41): Xaa is any aa, unknown, or other
MDLSRXASSDLSLGLHSHAHAHARVHAAAAPLRLVDDAKPXRLVGREAERERDDGERGEQHFSFLGHSLCVSARAARQRGWGAGGGKNFFLLVP

SEQ ID NO: 35148 - DNA, 750 bp, Zea mays
  misc_feature: Ceres CLONE 1414291-F
  misc_feature: Encodes the peptide sequence at SEQ ID NO. 35149
  misc_feature (323)..(323): n is a, c, t, g, unknown, or other
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaaactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctggtgcccagtgtccttcagaggntcagcactgcagcagcagtagaggagcccatcacgccgtcagtccatgtgaactacacaaagctcctcattaatggcnacttttggtgattccgcatcccgcaagaactttcccaactctggacccctaacaaggggaaggtggattgctcatgggggctgaggggtggacccaaaaggacatttaaccggtggcagaagctgcgggctcgcaagggtttttggaggaagggccatgtgcccgaagatgactggcctattggaaggccccggatcccaaacggggggtttggtggatttgaaaaagaaacccaaggggccagtttgtttggttttggaaacatggggacaacggggaaaccctatggagcaagcagccccatattgagaaacccccgggggggcccccccttagggggaacaaatgt

SEQ ID NO: 35149 - protein, 78 aa, Zea mays
  misc_feature: Ceres CLONE 1414291-F
  misc_feature: SWISSPROT Homolog: EC 1.2.1.3 Aldehyde dehydrogenase (NAD(+))
  misc_feature (50)..(50): Xaa is any aa, unknown, or other
  misc_feature (76)..(76): Xaa is any aa, unknown, or other
MARRAASSLVSRCLLARAPAGAPPAAPSALRRTVPADGMHRLVPSVLQRXSTAAAVEEPITPSVHVNYTKLLINGXFW

SEQ ID NO: 35150 - DNA, 773 bp, Zea mays
  misc_feature: Ceres CLONE 1414293-F
  misc_feature: Encodes the peptide sequence at SEQ ID NO. 35151
  misc_feature (561)..(561): n is a, c, t, g, unknown, or other
aagctggagctccccgcggtggcggccgctctatactagtggatcccccgggctgcaggaattcgcacgagaccattacctagaacatcctaatcgaaaaatacttcccctccctctttccacgataccaaaagaaaccgaaaaccatcgacgcgctccgtccaccctcccctaccccgcgtcctcctcgcctacgcctcccaggccagcggcaaaacccaaccctagatgggcgccgtcacctctacggtcgcggagagctttgcctttttcccgccgagaccgccgtcgtacgggttcgagcagccggcgccgcttccggcccctgccacacccgagcctccggccccggtcacatccaagccgccgcctccggccccggccacagccaagccgccgcctccggccccggccacacccaagacgcccccagcggtggaggagaagggaggggccgagctggaggcacctccgggcggcccgcggagggttaacgtggaggccccggcggttgccgaagaaccggggcacgggaggtggccgcgatgcacgcggcgccangcggagggccaaagttacggtggttctacttcccacggaaacgccgcccaacctcgggcggaaggaacaagctcttcgtggaagtctagggcccaccctaaatgttcaaccccttgggcggatgtactaataccgggcaacgggccaatctcccgggaaacccccgcgacacaaaaactcttttttctggaatagaaaagtgccataacgaa

SEQ ID NO: 35151 - protein, 175 aa, Zea mays
  misc_feature: Ceres CLONE 1414293-F
  misc_feature (111)..(111): Xaa is any aa, unknown, or other
MGAVTSTVAESFAFFPPRPPSYGFEQPAPLPAPATPEPPAPVTSKPPPPAPATAKPPPPAPATPKTPPAVEEKGGAELEAPPGGPRRVNVEAPAVAEEPGHGRWPRCTRRXAEGQSYGGSTSHGNAAQPRAEGTSSSWKSRAHPKCSTPWADVLIPGNGPISRETPATQKLFFLE

SEQ ID NO: 35152 - DNA, 730 bp, Zea mays
  misc_feature: Ceres CLONE 1414298-F
  misc_feature: Translation starting site: 215
  misc_feature (641)..(641): n is a, c, t, g, unknown, or other
  misc_feature (668)..(668): n is a, c, t, g, unknown, or other
  misc_feature (678)..(678): n is a, c, t, g, unknown, or other
  misc_feature (679)..(679): n is a, c, t, g, unknown, or other
aaagctggagctccccgcggtggcggccgctctagaactagtggatcccccgggctgcaggaattcgcacgagaccattacctagaacatcctaatcgaaaactcctcccccgcctcgccgccagtcagattcaccaccggctcccctgcacaaccgcgtccgcgctgcaccaccaccgttcatcgaggaggaggcgggacggagaccacggacatggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggatactccagcgagatgccggagatggnagccgtttcccgagaggagtacctggncctcctccgnncgcagagcagcggcttctcccagggcgtctccaagtacagaggcgtcgcca

SEQ ID NO: 35153 - DNA, 744 bp, Zea mays
  misc_feature: Ceres CLONE 1414299-F
  misc_feature: Encodes the peptide sequence at SEQ ID NO. 35154
  misc_feature (323)..(323): n is a, c, t, g, unknown, or other
  misc_feature (726)..(726): n is a, c, t, g, unknown, or other
aagctggagctccccgcggtggcggccgctctataactagtggatcccccgggctgcaggaattcgcacgagaccattacctagaacatcctaatcgaaaaagcggcgaggacgaagtggcccgcccaggaaatggcgtcgatgcagagctggcgcaaggcctacggcgccatcaaggacaccacaaccgttagcctcgccaacctcaactcggacttcaaggatctggatgtggcgatcgtgaaggcgactaatcacgtggagtgcccacccaaggagcgacacctgcgaagggtttgttgcggcgacatccatcgccaggncttagggcggatgtcgcctactgcatccacgcgcttgcccgccgtcttgccaagaacccgcaactggattgttgctctgaaagcacttgtagtaatccatagacttcttcggtgagggtgatcctacatttcgagaagagcttcttaactttacacaaaagggggcgtattctgcaactttcaaactttaaggatgactccagtccaattggcttgggattgttctggctggtgcgcaccataatggtttgtttttggaagaaaggttgaggtgcttcagagtttctgaagtatgatggtggagcttgagcgtttgtcccaaacagggtcaagggtcctgaaaagggtcacagtaaaaaccagagagttggattcccagggatttgttagagcagctggcaanaattgcagcaggtacaat

SEQ ID NO: 35154 - protein, 101 aa, Zea mays
  misc_feature: Ceres CLONE 1414299-F
  misc_feature (64)..(64): Xaa is any aa, unknown, or other
MASMQSWRKAYGAIKDTTTVSLANLNSDFKDLDVAIVKATNHVECPPKERHLRRVCCGDIHRQXLGRMSPTASTRLPAVLPRTRNWIVALKALVVIHRLLR

SEQ ID NO: 35155 - DNA, 719 bp, Zea mays
  misc_feature: Ceres CLONE 1414302-F
  misc_feature: Translation starting site: 313
  misc_feature (276)..(276): n is a, c, t, g, unknown, or other
  misc_feature (294)..(294): n is a, c, t, g, unknown, or other
  misc_feature (462)..(462): n is a, c, t, g, unknown, or other
  misc_feature (531)..(531): n is a, c, t, g, unknown, or other
  misc_feature (639)..(639): n is a, c, t, g, unknown, or other
  misc_feature (640)..(640): n is a, c, t, g, unknown, or other
caaagctggagctccccgcggtggcggccgctctagaactagtggatcccccgggctgcagtaattcgcacgagaccattacctagaacatcctaatcaaaactccactgctctgctgctcctcgcgccgccgcagcgacgtaatggcttccgccgcggtgctccggaacgccggctcccggcgcctcttctcctaccctactctccgcgccgctgcgatatatgtaccttttgcgctacccgatgcgcccgcggcggcggcagcgccggcccagncgccaccgacggccgggnaccctctgggcgaggtctatggccaccttcacgcgcacgaagccccatgtgaacgtcggcaccattggggcacgtcgatcacggcaaaaccactctcactgctgccattaccaaggtcctggccgaaggcagggagggccaaagccgttgcttttcgacgagatcgancaggctccggaggagaaagccagaggaatcaccattgcgacagctcacgtcgagtatgagacggctaanaggattatgctcacgttgattgtcaggtcacgcagattatgtcaagaacatgatcactggagtgctcaaatggatgggggtattcttgtcgtgtcagctcctgatggnncgatgcacaaactaaggacatattctcttgcccggccaggtggtgaccctcccttgtgtgctcttaaacaagttgatgc

SEQ ID NO: 35156 - DNA, 778 bp, Zea mays
  misc_feature: Ceres CLONE 1414306-F
  misc_feature: Encodes the peptide sequence at SEQ ID NO. 35157
aaagctggagctccccgcggtggcggccgctctataactagtggatcccccgggctgcaggaattcgcacgagaccattacctagaacatcctaatcgaaaaaaacccttctctcatcttcccgggttctgctcgttctatctgtccagcaaacttgaagcccccagcggccgcaaaccacggggaaccgtcggcatggaggtcgtatcgcattctgtgccttgcaaacaaaaatgacttcaaggcagttattgctgcacaacatactgcggccacgggagacccgaccaaggattatcagatggctgtctcgaacaagacccctgagtatctaaagatgaacccccttggaaagggtcctgttctgcacactcctgatgctcctggatttcagagacccgatattgagcgcaatgttgctcgcttgaaagaatgacaaccctccttctcggatcttcccgaagttgaacaagccccccgttggaaaaatggtatgtcctctggctgcaacagaagattaatccggcatgctgggatggaaacttgtattcccccgtcttgggggaaatccccttatggctcacccaacaagaagttaacccctttttgcgtgcaataccaggagatgcctctgtaggtacagcaaaaaaaatttttgcctttgagaaccgcagccggagggaacaatcatggttaccaaacgctaacaattggtcccggaatggtacccccttccctgggaaatgggacggaacttttgtcctcaaaaggttcctct

SEQ ID NO: 35157 - protein, 44 aa, Zea mays
  misc_feature: Ceres CLONE 1414306-F
MAVSNKTPEYLKMNPLGKGPVLHTPDAPGFQRPDIERNVARLKE

SEQ ID NO: 35158 - DNA, 739 bp, Zea mays
  misc_feature: Ceres CLONE 1414307-F
tacccgcggtggcggccgctctagaactagtggatcccccgggctgcaggaattcgcacgagaccattacctagaacatcctaatcgaaaaaccaacagccaatccacacctcgcttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatcgccgtcgcctccccttcgccgctattttccagtcgccgggatcagccgagttggatctcgaggcataaagcgttgcgggcgcccggcgaggatacgatgcctgcggtgctcgccgcattcgctacccttcgagccgccgctgccatcgcctccggggactcctccttcccctgttcccatcgtctcaagcatcgttttagcagtagtaattttagaagcaaggaattgccattaacctttgcgttccctcccgtcgcgaaggtccatcggttcggccccaccttcacattttccgttatgttctggtagcctcaaatctaagttttaatttaactacggaaaacccccccctcctcacacctgcaagccgcccactcccccatacactttacataacacttgctaacctctatcactaagaaaatcagacaaactccctcatctttcaactgtttcacacccgtttgaagcaccaccacg

SEQ ID NO: 35159 - DNA, 747 bp, Zea mays
  misc_feature: Ceres CLONE 1414312-F
  misc_feature: Translation starting site: 175
  misc_feature (239)..(239): n is a, c, t, g, unknown, or other
  misc_feature (383)..(383): n is a, c, t, g, unknown, or other
  misc_feature (392)..(392): n is a, c, t, g, unknown, or other
  misc_feature (434)..(434): n is a, c, t, g, unknown, or other
  misc_feature (435)..(435): n is a, c, t, g, unknown, or other
  misc_feature (658)..(658): n is a, c, t, g, unknown, or other
  misc_feature (665)..(665): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (695)..(695): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (704)..(704): n is a, c, t, g, unknown, or other
  misc_feature (705)..(705): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (723)..(723): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
aaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggngcaggagaagacgcggctgctcctccaggagacgggcctcccgagcgggctgctcccgctgcgggacatcatcgagtgcggctacgtggagggagacgggcttcgtgtggctccgcagcgcccgcagggtggacacttactcgncaagccggnccgcacgggtctacgggggccaggggggtccgggggtggccnnaaaaggcccggctcaaaaaaaccggggcgtaaaggccaagaaaaggcgggggggggccaccctccagaaaattgggggaaaaacccccccccggggaaatctccccggggaggggcccggggggggggtcccccaaattttcccccccgggggggttttaagggggagaggagcgcccccccaaaaaccggggttttcccccccggggggggggagaaaaaanagggggnttnnnnnnnnnnngnnnnnnnnnnnnnngngnnnngganngnnnnnnnnnnnnntggngnnnnnnngnnntagagtggtgga

SEQ ID NO: 35160 - DNA, 684 bp, Zea mays
  misc_feature: Ceres CLONE 1414313-F
  misc_feature: Encodes the peptide sequence at SEQ ID NO. 35161
cacttacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcaacggattttgagggtgatggcatcgacaacctcagcgagaacgatgtcagcgactaggagatcgatgctgacgacctcccccgaaaaatgtggaacggccaggtccagctaaagagggatcggggagaggcacgctcataccttgccccgccccggcctggatcttgaccaaccctattactatgaaatctcccaactatccctccccaaaaaaatggttagggccccgcaccgccatccccagcaacagcctccccctgaacacgcgctaactgccccggagcccctccaacttactcatcctcctcccagccctcctctaccacctcccctctcgccccctccctccccccccccg

SEQ ID NO: 35161 - protein, 34 aa, Zea mays
  misc_feature: Ceres CLONE 1414313-F
MLDHLAIIASELGDDATDFEGDGIDNLSENDVSD

SEQ ID NO: 35162 - DNA, 704 bp, Zea mays
  misc_feature: Ceres CLONE 1414314-F
  misc_feature: Encodes the peptide sequence at SEQ ID NO. 35163
tggagctccccgcggtggcggccgctctagaactagtggatcccccgggctgcaggaattcgcacgagaccattacctagaacatcctaatcgaaaaatccaacgacccacactgagacgtcccctccccgctccgtcctctctcctctgccgccgagacgacgcgatggcggggtccgccgccttgccgccgctcgccgccttcgcgtcgctccttaccgcgcggcgcttcgccgccgccaggtccgcgctccggtccctgctcacgccgcgcctactggcggtgccgttcgcggacctcgccgcctcgtcgctcccgcgcggcgcgccgccgcacgccgtggtggcgttccacgacatgctcttccgcgcgtacgcggacgcgggcgcggcgtgccgcgcggccgaggcgctcgacgccgccgtgtccccgcctcggtagcctcgacccgcgctcgctcacgttctcgctggtctcgctccgccgcggcgggggcctcgcggacgccgcgggctcctgggagcggcgctcggctcgtgccggcctccgtctcgccggtcgcccggtccgtcgtcgtccacgggtctgcaagtcggggcgggtggacaacgcgcgccgctgttcgacatatgcctccccccggcgggagcctgaatggcctgggctacaatcgctggttggctgtacgtgggcaaaagggtgg

SEQ ID NO: 35163 - protein, 91 aa, Zea mays
  misc_feature: Ceres CLONE 1414314-F
MAGSAALPPLAAFASLLTARRFAAARSALRSLLTPRLLAVPFADLAASSLPRGAPPHAVVAFHDMLFRAYADAGAACRAAEALDAAVSPPR

SEQ ID NO: 35164 - DNA, 716 bp, Zea mays
  misc_feature: Ceres CLONE 1414315-F
  misc_feature: Encodes the peptide sequence at SEQ ID NO. 35165
  misc_feature (579)..(579): n is a, c, t, g, unknown, or other
  misc_feature (580)..(580): n is a, c, t, g, unknown, or other
caaagctggagctccccgcggtggcggccgctctagaactagtggatcccccgggctgcaggaattcgcacgagaccattacctagaacatcctaatcgaaaaaaggaaacgtcacgtcaccaccacacacctcttcggctcttcctcttctcctccgtatagcggcgggcctccgtcgccccccttccaccccgttttgccgccccgcaggccacagcccaaaatcctcctcgtcgctggtgccctctccgcggcctcctccgccagccatggccgccgctgggcccgggctctactccgacatcgggaagaaggcaagaggtctcctgtacaaggactaccacactgaccggaagttcacgctcaccacttacgccgccaacggagctttcaaggcgcgtgtcaccatggacatgaagcaccgcgtcgtccgcgccatgatcgcgggtagcatgggaagacggtgatggcgcacccgtgcatgtccaggataagaccgagtcggccattactgctgcagcacaaggaaagatgaagctatctttaataaatccagggccagctgagcacaccatggnnactgtggatgtgaaagcacttcagaatcaaaagtgacactaacatcacagttcacgagctagcacacccaggcctggagggattttttatgcattcctttcccgtacagaaatctgcaaagctgaacctcagactg

SEQ ID NO: 35165 - protein, 65 aa, Zea mays
  misc_feature: Ceres CLONE 1414315-F
MAAAGPGLYSDIGKKARGLLYKDYHTDRKFTLTTYAANGAFKARVTMDMKHRVVRAMIAGSMGRR

SEQ ID NO: 35166 - DNA, 725 bp, Zea mays
  misc_feature: Ceres CLONE 1414319-F
  misc_feature: Encodes the peptide sequence at SEQ ID NO. 35167
  misc_feature (339)..(339): n is a, c, t, g, unknown, or other
  misc_feature (353)..(353): n is a, c, t, g, unknown, or other
  misc_feature (426)..(426): n is a, c, t, g, unknown, or other
aagctggagctccccgcggtggcggccgctctagaactagtggatcccccgggctgcaggaattcgcacgagaccattacctagaacatcctaatcgaaaaatccaatacccccacgaacccactctctctccccacgatggcaaaaatggcgatggcgtcctcccgcctcccggctctcctctgcctcgccgccgtcgccgtcgccgtcgcggcggaggccgccgccgccgccggagaaggcggcctccgcctgccccgcgacgccacgttcccggcggcgcaggcggagcggctcatccgcgcgctcaacctcctgcctaaggagaaggaggcgggnccggccgcgggcgncggcgacgggcccagcgtgccgcccggggagctcctagagcgtcgcgtccgggtgcccggggcgcccgccggngtcggggacctcggccaccacgccggaaacttccccctgccgcacacgcacgaacgcagaaagttctacttcttcttcgaatcgaggggcagaaaaaaggagacaaccccgtcgtgatctggttcaccgaagggcccggcttgcagaacgaagttggccggcttcaaaaagaatggggcccttaccattggcaaaaacagggccgcttggcggaaaaaaattcgggtggggaacgcattttaaaaaaacatatttggggaccacccaaccggaaagggcttaagatcaacactggaggg

SEQ ID NO: 35167 - protein, 129 aa, Zea mays
  misc_feature: Ceres CLONE 1414319-F
  misc_feature: SWISSPROT Homolog: EC 3.4.16.5 Carboxypeptidase C
  misc_feature (67)..(67): Xaa is any aa, unknown, or other
MASSRLPALLCLAAVAVAVAAEAAAAAGEGGLRLPRDATFPAAQAERLIRALNLLPKEKEAGPAAGXGDGPSVPPGELLERRVRVPGAPAGVGDLGHHAGNFPLPHTHERRKFYFFFESRGRKKETTPS

SEQ ID NO: 35168 - DNA, 673 bp, Zea mays
  misc_feature: Ceres CLONE 1414321-F
  misc_feature: Translation starting site: 212
  misc_feature (365)..(365): n is a, c, t, g, unknown, or other
  misc_feature (366)..(366): n is a, c, t, g, unknown, or other
  misc_feature (499)..(499): n is a, c, t, g, unknown, or other
aaagctggagctccccgcggtggcggccgctctagaactagtggatcccccgggctgcaggaattcgcacgagaccattacctagaacatcctaatcgaaaagcggcttccgcatcctccgcttcgtgtcgtctgccctgctgcccaagcctccggaggttctaccggagccggctcactctcgcgacaccgccgcggcctccggctatatatggacggcgaggaggcgccccttggcgcgctcaacctggctgagtacgcccccgccggcgcccgcaccgtcgactgctacaggcgtatccgcaaagaaatcggcgagggcacctacggtgaggtattttgaagctgtggatattattactggnngaagagcagcacttaagaaaataaaactggatgatggcaaagaaaggttttccacgcaaatcttgcgtgagattaaactattaaaaaaagtgggttcctgaaaacttcatccgaattggaaggaaattggganaatttcccgggttctcgacatgggaaaaggggggaaacaaagagacccacctttttggggggaaaatccccacggggggggtgaaaaacggggccaccggttttaaaaaaaatttttgccccatagggcccccccccaagaaggggggtttttttgggggggcggctttaaaaa

SEQ ID NO: 35169 - DNA, 741 bp, Zea mays
  misc_feature: Ceres CLONE 1414324-F
  misc_feature: Encodes the peptide sequence at SEQ ID NO. 35170
  misc_feature (434)..(434): n is a, c, t, g, unknown, or other
  misc_feature (489)..(489): n is a, c, t, g, unknown, or other
  misc_feature (511)..(511): n is a, c, t, g, unknown, or other
  misc_feature (579)..(579): n is a, c, t, g, unknown, or other
aaagctggagctccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatggtggtggcgtcggtgctccaagaaccgggcggtgtcgacggcctcccgccggggcctccgggttggccgggtggtggggaacctgttccaggtgatcctgcagcgacggcccttcatgtacgtggtgcgcgacctccgggagaagtacggncccatcttcaccatgcggatggggcagcgcaccctcatcgtggtcacctcggcgnagctcatccacgaggcgctggntgaagcagggccccatgttcgcgagccggcccgaggacagcccccaccgcctcctcttcagcgtcggnaagtgcaccgtcaactcggggcctacgggcccctgtggggtgctctgcgcccaactccgtcgccgagatcgggtccccgcacgcgcaagggctctcctgaatccggaatggccgtggaccgaattgggcccctttgcccaactcgggggaacgtgcctgcgt

SEQ ID NO: 35170 - protein, 114 aa, Zea mays
  misc_feature: Ceres CLONE 1414324-F
  misc_feature: SWISSPROT Homolog: EC 1.14.13.11 Trans-cinnamate 4-monooxygenase
  misc_feature (31)..(31): Xaa is any aa, unknown, or other
  misc_feature (38)..(38): Xaa is any aa, unknown, or other
  misc_feature (61)..(61): Xaa is any aa, unknown, or other
MYVVRDLREKYGPIFTMRMGQRTLIVVTSAXLIHEALXEAGPHVREPARGQPPPPPLQRRXVHRQLGAYGPLWGALRPTPSPRSGPRTRKGSPESGMAVDRIGPLCPTRGNVPA

SEQ ID NO: 35171 - DNA, 753 bp, Zea mays
  misc_feature: Ceres CLONE 1414327-F
  misc_feature: Encodes the peptide sequence at SEQ ID NO. 35172
  misc_feature (652)..(652): n is a, c, t, g, unknown, or other
caaagctggagctccccgcggtggcggccgctctagaactagtggatcccccgggctgcaggaattcgcacgagaccattacctagaacatcctaatcgaaaaacggcccaccccgatctcataatcgtcgtcttctcccacttcgacgcggctagggccggcgctaccatctcctcttctcttccggcggcttctccgtcccgtcgatcaaccgcgccgccttcgccagtataccccgcattgagccgtcatcgttacctgcgccgaccggcacctctgtagcctcttctccaggggttgcacgaggaggaggaggttcgggcttcgccatgtcgaagtcgaacctagatgatctgcttctgcaggcagccggccggacggggaagaaccactcccggccgagcaacccgcggtggaactctgggggaagcggctccgacggcttcgacgacgacgactcggacgccgcgccgacctactcgaggaagaagccttcgtcgcaggttcccgctcagaagcggcaccagccagagcagggcggccggcgtgccagtggcgggtggaaaggacgagacgacgaggacgaagatgggcgtcgcagtgggcggggaggactcggacagcgccccctcggtggggagtgacctatancaggatgaggacgacaaggagcgcctggagacatgtctgagctgcaaaggagatgatcctggctgatccgggcacccgcctccatgataacaggctcaagc

SEQ ID NO: 35172 - protein, 104 aa, Zea mays
  misc_feature: Ceres CLONE 1414327-F
MSKSNLDDLLLQAAGRTGKNHSRPSNPRWNSGGSGSDGFDDDDSDAAPTYSRKKPSSQVPAQKRHQPEQGGRRASGGWKGRDDEDEDGRRSGRGGLGQRPLGGE

SEQ ID NO: 35173 - DNA, 725 bp, Zea mays
  misc_feature: Ceres CLONE 1414333-F
  misc_feature: Encodes the peptide sequence at SEQ ID NO. 35174
  misc_feature (692)..(692): n is a, c, t, g, unknown, or other
  misc_feature (720)..(720): n is a, c, t, g, unknown, or other
aaagctggagctccccgcggtggcggccgctctagaactagtggatcccccgggctgcaggaattcgcacgagaccattacctagaacatcctaatcgaaaaatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctctccgcgctccacatcgccgccgcgaatggccgcctcgaggtgctgtcaatggtcttggatcacggggtgccgccggacgtggtgaagctcctgcaggccggcgccaatatcctcatgttcgactcccagcacgggcggacctgcctgcaccacgcgtcctacttcggccacgtcggctgcctgcaggccatcctcacggcggcgcggaccacgccggtggccaactcatcgggtttcgctcggttcgtcaacgtgagagacgaccacggngccacgccgcttcacctcgccgccaggnagggc

SEQ ID NO: 35174 - protein, 149 aa, Zea mays
  misc_feature: Ceres CLONE 1414333-F
  misc_feature (46)..(78): Pfam Name: Ank Pfam Description: Ankyrin repeat
  misc_feature (148)..(148): Xaa is any aa, unknown, or other
MGHGVSCARTGDEHDYFRAAQVGDLEALEALLDADPSLARRATLYDRLSALHIAAANGRLEVLSMVLDHGVPPDVVKLLQAGANILMFDSQHGRTCLHHASYFGHVGCLQAILTAARTTPVANSSGFARFVNVRDDHGATPLHLAARXG

SEQ ID NO: 35175 - DNA, 795 bp, Zea mays
  misc_feature: Ceres CLONE 1414337-F
  misc_feature: Encodes the peptide sequence at SEQ ID NO. 35176
  misc_feature (305)..(305): n is a, c, t, g, unknown, or other
aaagctggagctccccgcggtggcggccgctctagaactagtggatcccccgggctgcaggaattcgcacgagaccattacctagaacatcctaatcgaaaatccaacctgttccgatccgccccgagccggctggccatggcgatcagggctggccgctcggccctccacctccacgctctcgctttcctcatcctcgccgcctccccctgcctccaagtccaagctctagtggaccatcgcaaacaggtatctgactggggtaggcaacccaactttgaactgcagaatatgtcctcgagtcnaagggatggctctcatctcttgggcagatcaaaggaaatacacacaggaaactaagggggggaatggtggtaggaaccaaatgggagtaatgccgcaggatgattaaccattaagttaacctggaaaccccggttttgaacggtcaaaagctgtggattctgcagtgcggggaaaaattaaccctccgggaacgcgaaaagggaaagggaaaggccaatttcaggggttcccccggtgcggaaacaaaagggacatgggccaaaaaaatttttgggttttggcaaatttggggaaaacttttttcccctttagggggggttttttaaaaacctccgggagacgccgcccctcccttggggaaaaatactggtggggggcaatattttccaaaaaggggttctcaaaaaaaaaaaagagggggggcgcggtttttataaaaaacaagggctttttttttttttttttttgaaaaaaaaccccccgcggggg

SEQ ID NO: 35176 - protein, 73 aa, Zea mays
  misc_feature: Ceres CLONE 1414337-F
  misc_feature (56)..(56): Xaa is any aa, unknown, or other
MAIRAGRSALHLHALAFLILAASPCLQVQALVDHRKQVSDWGRQPNFELQNMSSSXRDGSHLLGRSKEIHTGN

SEQ ID NO: 35177 - DNA, 738 bp, Zea mays
  misc_feature: Ceres CLONE 1414339-F
  misc_feature: Encodes the peptide sequence at SEQ ID NO. 35178
  misc_feature (387)..(387): n is a, c, t, g, unknown, or other
  misc_feature (406)..(406): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (413)..(413): n is a, c, t, g, unknown, or other
  misc_feature (415)..(415): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (422)..(422): n is a, c, t, g, unknown, or other
  misc_feature (431)..(431): n is a, c, t, g, unknown, or other
  misc_feature (490)..(490): n is a, c, t, g, unknown, or other
  misc_feature (496)..(496): n is a, c, t, g, unknown, or other
  misc_feature (497)..(497): n is a, c, t, g, unknown, or other
aaagctggagctccccgcggtggcggccgctctagaactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcagaagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgntcatctccctcccactcgncgnngnngngnnngangcggcccangaaagggcgtcgcgcacgcgccggcgggggcgccgccgttgtccccgtccacatcccgnccgtgnntcaagaagatcagggagtgggcgtccacgtcggttcgttcccgcactacctgaagacggggacccggtccttcaggaagggggggaacgggaaccggaaagggaatccgggggccagggtccaaaccgctccacttcgaggccgaaagggccaccaatggtcccgggggtcccaaacctttgtcgggggccggggccccagaggccccccctcgttgggccctgggacccctggggaaatt

SEQ ID NO: 35178 - protein, 159 aa, Zea mays
  misc_feature: Ceres CLONE 1414339-F
  misc_feature (43)..(43): Xaa is any aa, unknown, or other
  misc_feature (49)..(49): Xaa is any aa, unknown, or other
  misc_feature (50)..(50): Xaa is any aa, unknown, or other
  misc_feature (51)..(51): Xaa is any aa, unknown, or other
  misc_feature (52)..(52): Xaa is any aa, unknown, or other
  misc_feature (53)..(53): Xaa is any aa, unknown, or other
  misc_feature (54)..(54): Xaa is any aa, unknown, or other
  misc_feature (57)..(57): Xaa is any aa, unknown, or other
  misc_feature (77)..(77): Xaa is any aa, unknown, or other
  misc_feature (79)..(79): Xaa is any aa, unknown, or other
MSPPPPPPLLRNELSRRTAVLGLRLWVLVGIAVGAAFVLLLVXISLPLXXXXXXAAXERASRTRRRGRRRCPRPHPXRXSRRSGSGRPRRFVPALPEDGDPVLQEGGEREPERESGGQGPNRSTSRPKGPPMVPGVPNLCRGPGPQRPPLVGPWDPWGN

SEQ ID NO: 35179 - DNA, 745 bp, Zea mays
  misc_feature: Ceres CLONE 1414340-F
  misc_feature: Encodes the peptide sequence at SEQ ID NO. 35180
  misc_feature (684)..(684): n is a, c, t, g, unknown, or other
  misc_feature (685)..(685): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggtgttccccggagacgatccgcgacccgcgcgggttcgccgtgaaagtctacacccgcgagggcaactgggacctgctgggcaacaacttccccgtcttcttcatccgcgacggcatcaagttccccgacgtgatccacgcgttcaagccccacccgccgtcgcacgtgcaggagtactggnncggtgtcgacttcctgtcgcacctcccgagangctgcacaccttctcttcctcttcgacg

SEQ ID NO: 35180 - protein, 190 aa, Zea mays
  misc_feature: Ceres CLONE 1414340-F
  misc_feature (18)..(190): Pfam Name: Catalase Pfam Description: Catalase
  misc_feature: SWISSPROT Homolog: EC 1.11.1.6 Catalase
  misc_feature (171)..(171): Xaa is any aa, unknown, or other
  misc_feature (182)..(182): Xaa is any aa, unknown, or other
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERCSPETIRDPRGFAVKVYTREGNWDLLGNNFPVFFIRDGIKFPDVIHAFKPHPPSHVQEYWXGVDFLSHLPRXCTPSLPLR

SEQ ID NO: 35181 - DNA, 751 bp, Zea mays
  misc_feature: Ceres CLONE 1414343-F
  misc_feature: Encodes the peptide sequence at SEQ ID NO. 35182
aaagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggccgaggcccccgcgtacctgcaccgcgacgacttcgcgcggtacctggacgggtacgccgcgcggttcgccgtccgcccgcgcctccgccgcgaggtccggtcggcgcggtacgaccccgcgagcgcgcggtgagaggtggaggccgtggacctcggcacgggccaggcccgagcggtacccggcgaggttcctggtgggtcgcgtccgggggagaaccccaagaaattcctgcccgaaggtgccctggcctggaggcgtttcccccggccaggtggatgcacgcaattgtagtaccgggccggccaagggggattgcccggcaaggcccctgcctcc

SEQ ID NO: 35182 - protein, 114 aa, Zea mays
  misc_feature: Ceres CLONE 1414343-F
MAAVAEEEVIVVGAGQSGLAVAACLSLRGVRALVLERDDCVGSLWRKRAYDRLHLHLTKKYCALPHAPHPAEAPAYLHRDDFARYLDGYAARFAVRPRLRREVRSARYDPASAR

SEQ ID NO: 35183 - DNA, 922 bp, Zea mays
  misc_feature: Ceres CLONE 1414346-F
  misc_feature (11)..(11): n is a, c, t, g, unknown, or other
  misc_feature (14)..(14): n is a, c, t, g, unknown, or other
agcccctcccnaanataaaaaataaaacaaaaatccccctctttttataatagctggactccccgcggtggcggccgctctataactagtggatcccccgggctgcaggaattcgcacgagaccattacctagaacatcctaatcaaaaacttctgccattccgccgaacaccttccccaatcgtgcgcctccggccatgggggaagcctccgacgcggcggtaggcgtatctgcccggctcctgcagctggcggccgaagaccactctgccgcgctcggtgacctccttgcggcacccccgtttcttgctgacgagcccccgcccggggacctcccccggcgcccgggcggaggagcctactaaccccccgttcttggctccccgccgcccgcaacacttccccgggccctccccttccaagacccaaatctttttctgcccccccgcaaaccgacacccccccccatggcctcaccgcgggggccccctctctcgcacgggcgcattttcttcctcgtgcgaacccgcggaccacatactctcttcgtttcgacaacatacccaggataatcacccccctccccccacaagctcctgcggagcccccgccaccaccccccggttggggtcacaacaataccgtcacacacaaatatattatggatgggcgacctgttgactgagcctcttccacacagaaaaaattcctttcaactgaaaacaaaaaaacgcccctctccatcatcaccccccccgcgtcccgcccctcccctgagtttgtctccctccttcatcctcaatatcccctcccccgcgcgcaaaggagagagtggggtgcgccgcccccgccacctgccacctctcggtgctactcccccttataaaatgagctgtgctaggcgccaccacccatgctaccc

SEQ ID NO: 35184 - DNA, 678 bp, Zea mays
  misc_feature: Ceres CLONE 1414347-F
  misc_feature (342)..(342): n is a, c, t, g, unknown, or other
  misc_feature (378)..(378): n is a, c, t, g, unknown, or other
aaagctggagctccccgcggtggcggccgctctagaactagtggatcccccgggctgcaggaattcgcacgagaccattacctagaacatcctaatcgaaaaatcaagttttgtagtgttgttagtgtttctaccgtatgtctgatttgtactttattagtacttaagctctgtctttgagaaatataacatactagctctgttcactgcaagaatgtggccttaaacactagtttgatttcagggtggttatgttctttatcgcctcttctggaaaccagaggagaatactgtgcgctccagcccagaacaaatgcatagaagtggaaactcgactactanctcccgttcttcacgtgatcaccagaggcgaatgangtagctactacaccattaaatagaaatctctagaatctgctctgcatgatccgatggagctgcccaatttctgctgaacccctgctggaccaagaaaatggcgcgggcgaacaaaatgaaaatttggggctactgccccgttgtttcccaattacttttccgggaaagggtgggggggaactaaattttaacctttccgttgtggttcccccccttttttttatcccccaaagggaatgggcccccggccatttttttgggttttttccccccctttcccggttgaaaaagtttttcccg

SEQ ID NO: 35185 - DNA, 792 bp, Zea mays
  misc_feature: Ceres CLONE 1414350-F
  misc_feature: Encodes the peptide sequence at SEQ ID NO. 35186
  misc_feature (27)..(27): n is a, c, t, g, unknown, or other
  misc_feature (35)..(35): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
ttcctctccccccatccctcccccccntattattnanggtgatgnnaacaaactggagctccccgcggtggcggccgctctttaatagtggaacccccgggctgcaggaattcgcacgagaccattacctagaacatcctaatcgaaaagctggtgcttctacggggcctggccatttgaattcgagtggtgcgtgtatagagcgtgagagagagaaaagagagtggctcttgcgctcagcagtccagttcttgaatcaagagctgcgatacgtgctcgcctgacgccgatgggccggagcctgagcccgctgctacggcaggagctggacaacctggacaaggacgctgacagccgccgcgccgccatgaaggcgctcaagtcgtaccccagaaacctggattccaaggtcctccccgtacttcctcgccgaagggctcgaaccccaccccgggcctgcgccccgcccccggcagtgggtttggccccccggaggcaagttccccattctgcccttaacaaggggcctggcgccggtggccccgccccaaaatttgggccccagaatcgcgaacattcatgggcccccctcttggggcaccccctcccccccggggggggcccccttccccttcccccacgagcgtctctcagaggggggggccccccccggcggggggaagaagaattccacccctcgcgcccctaaaagaaaaaatgaggcaacaaatccccccccccctccctccagcctctctatccgacgctctatcggggggggcaccccacaag

SEQ ID NO: 35186 - protein, 139 aa, Zea mays
  misc_feature: Ceres CLONE 1414350-F
MGRSLSPLLRQELDNLDKDADSRRAAMKALKSYPRNLDSKVLPVLPRRRARTPPRACAPPPAVGLAPRRQVPHSALNKGPGAGGPAPKFGPQNREHSWAPLLGHPLPPGGGPLPLPPRASLRGGGPPRRGEEEFHPSRP

SEQ ID NO: 35187 - DNA, 726 bp, Zea mays
  misc_feature: Ceres CLONE 1414353-F
  misc_feature: Encodes the peptide sequence at SEQ ID NO. 35188
  misc_feature (671)..(671): n is a, c, t, g, unknown, or other
  misc_feature (674)..(674): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcaaaaaaaccgctattcgtgtcctggcatccgcagagagtttgttccgtccaggcaatcaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccggttccagagccacgccgtgctggcgctccaggaggccgccgaggcctacctcgtcggcctcttcgaggacaccaacctctgcgccatccacgccaagcgcgtcaccatcatgcccaaggacatccagctcgcccgccgcatccgtggcgagcgcgcgtagccatcatctcccgagatctgatgaatgtctagttaccaaacaaataggcgtattagcgncgntgntctgtattcgttattttggattcggtgcagggaaaacagctttactgat

SEQ ID NO: 35188 - protein, 136 aa, Zea mays
  misc_feature: Ceres CLONE 1414353-F
  misc_feature (58)..(132): Pfam Name: Histone Pfam Description: Core histone H2A/H2B/H3/H4
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 35189 - DNA, 684 bp, Zea mays
  misc_feature: Ceres CLONE 1414360-F
  misc_feature: Translation starting site: 268
aagctggagctccccgcggtggcggccgctctagaactagtggatcccccgggctgcaggaattcgcacgagaccattacctagaacatcctaatcgaaaaaaaacgcgcgcacacacaccgtacccctcagctcgcgccaccggccaccgcgcgcacacagaacgcgtgctccgtccgtcccccctctgcctcgcgcgcgcagggttagcgtgagctgatcgagcaacgagagctagctagctagctagctagaggacacgacacgatggccttgcaggtcaccggcggcgtgggctgctgctgccctccgggcagtgcccggcggttgccgcaagcggcggcgctgtgtcgcccgccccgcgcggtagtgtccggcgcaaccagggtggtggaggaggacgagggcaaggtgaggctgggcggctcaggcgtcgcggtcaccaagctcggcatcggcgcgtgttccctggggcgacaccacctactggaacgacctcccagtgggatgataggagactgaagaaagcacaggacgggttcgaagggagcatcgataacgggatgaccttcttcaaatatggcaaaattttccggaacagcccttgaggggagcaagcaattctgaaaattttactgagggggtttccctccggggaaggggcaccaaaaggaaacaataccg

SEQ ID NO: 35190 - DNA, 787 bp, Zea mays
  misc_feature: Ceres CLONE 1414363-F
  misc_feature (359)..(359): n is a, c, t, g, unknown, or other
  misc_feature (360)..(360): n is a, c, t, g, unknown, or other
aaagctggagctccccgcggtggcggccgctctagaactagtggatcccccgggctgcaggaattcgcacgagaccattacctagaacatcctaatcgaaaaggttcttcctagcgtctccccgttcttctctccgtagtagctaacagtatagtgtggcctcgcatggagactttccctcctcgctggccccgcatctggcccggattaaccgccttgggctccctccccagattgccccacccaccgtcagcctcgtcaggtatgtctagtgttccctaaccttgacgcttctcccttctcggcgcctgcttcgttggttgccttcagcggacgccgccgattcggctctcctggtnncgcgcctcccagattgccccaccaccgtcagcctcgtcaggtatgtctagtgttccctaaaccttgacgcttcttcccttcccggggcctggttcgttggttgccttcaagggaggccgccgatttcgctctccctgttcggggcccgggttttggaaaaaaaaaaggtaactttctggggaacatggattaaaagggggggggggcccgggctttaaatggggacaaaaagaagggggccctagaaaatctccccccggggaatttcccggggtttttaaggggggaaaaaaaaaccccgactcttttttttgggccggggtggagtctcttttccggggggacaaaagggttcaccccccccccccccggtgtggtgggggggaaaaaaatctccctccccgctttaaggggcgcgaaaaaacaa

SEQ ID NO: 35191 - DNA, 761 bp, Zea mays
  misc_feature: Ceres CLONE 1414364-F
  misc_feature: Encodes the peptide sequence at SEQ ID NO. 35192
  misc_feature (503)..(503): n is a, c, t, g, unknown, or other
  misc_feature (582)..(582): n is a, c, t, g, unknown, or other
  misc_feature (591)..(591): n is a, c, t, g, unknown, or other
  misc_feature (618)..(618): n is a, c, t, g, unknown, or other
  misc_feature (646)..(646): n is a, c, t, g, unknown, or other
  misc_feature (712)..(712): n is a, c, t, g, unknown, or other
  misc_feature (761)..(761): n is a, c, t, g, unknown, or other
aagctggagctccccgcggtggcggccgctctagaactagtggatcccccgggctgcaggaattcgcacgagaccattacctagaacatcctaatcaaaaaataatggcaaatttctcgtccccagcaaagtccctccattcggtctcatctcccatctctcttctctctctcccgcgacatcagcggcggcagcggtggggtggggggacggcattgcgagctcacagtctcacaccacccgccgcgtggtgattccgagaggttgctgtgccgctggctatgtagtgatgtggaccgtgatctcgacggctatccgcggctgagcgggcggcggcgatgaacgaagcgagcgccagcgctggcgtcgggaccggctctggcggggaggtgccgctggtatacaaggcctggaaggggaacaatgtgtttttactgaaggggagattcatatttggtcctgatgcaagatccttgtttgtcaccatgttccttattgttgcngcagtatcaatcttctgtccattagttgcgaaggaattgatggataaattctcttatggtctgggattaccggttatgnatgcagcangtctattcacagcatatgatctgagtnctctgcttctaacttctgggagagaccnggggatcataccctccgttgtaagatcagaaatgcagaacagataaccatttggaaggcaatgacnagacccctgcatctgttgctttatcatctacacatcattgcggttggtn

SEQ ID NO: 35192 - protein, 117 aa, Zea mays
  misc_feature: Ceres CLONE 1414364-F
  misc_feature (82)..(82): Xaa is any aa, unknown, or other
  misc_feature (85)..(85): Xaa is any aa, unknown, or other
  misc_feature (94)..(94): Xaa is any aa, unknown, or other
  misc_feature (103)..(103): Xaa is any aa, unknown, or other
MNEASASAGVGTGSGGEVPLVYKAWKGNNVFLLKGRFIFGPDARSLFVTMFLIVAAVSIFCPLVAKELMDKFSYGLGLPVMXAAXLFTAYDLSXLLLTSGRDXGIIPSVVRSEMQNR

SEQ ID NO: 35193 - DNA, 715 bp, Zea mays
  misc_feature: Ceres CLONE 1414365-F
  misc_feature (418)..(418): n is a, c, t, g, unknown, or other
  misc_feature (521)..(521): n is a, c, t, g, unknown, or other
  misc_feature (540)..(540): n is a, c, t, g, unknown, or other
  misc_feature (546)..(546): n is a, c, t, g, unknown, or other
aaagctggagctccccgcggtggcggccgctctagaactagtggatcccccgggctgcaggaattcgcacgagaccattacctagaacatcctaatcgaaaaagtcagttcctcctactcccgatccatttgcagagggcagcagccacctcctctccccgcggccgagctcgcgcctcgcccgccgcctgaactcgtcttgcctgcggccgatctcccccctccgttcttcgccgcaacccggagaggagaccgcgctcggtcgagcaccccctggggcagcgtcctcgcgaccagctccggcgcggcgtccgccctcagcagcccgggtgtccccgggaacgtctccggctcggccggcacacagctcgacaggcttttcagttcagtgcagtgtaccaaagatctctggtaattngtgtatgagatcagttaactgataaagacatgtgaagaaccagtgatcagtaatctgtacgcttcagattgtagtatccttgagatggatggaaagagatcangcttatggtaaatctggtngatatncatgggaggtcagcaagttctgggctgactagactagtaaaaatacgggctccatctcaatcatcaatgggaaaatgaggttccgaaacggtattaaaaagatgggtgacattccctgcacaaagtttgccacttggacgggggggtttccaataccaaaacgggggag

SEQ ID NO: 35194 - DNA, 733 bp, Zea mays
  misc_feature: Ceres CLONE 1414366-F
aaagctggagctccccgcggtggcggccgctctagaactagtggatcccccgggctgcaggaattcgcacgagaccattacctaaaacatcctaatcaaaaaccgaagacgcagcggaccagtagccggaactggcgctataaaacataccaaggccgcctcgctcgctcagcatacggaggcagccgccggtacgccgcgcgcgcgtgcagtcacccatccgtccgtccgtccgtccgtcgtccgccgtccaccgtcagcgcgcgctcgccaccgcacccagctagcagcacaagaaaagtctggtggcgtcggcggcggtgccggcggccggcttgccacagtccaatccttggaccgggcaaaaagcagatgaaggcgccgagcgagcaagctagcgcgcccttcgtcgctacgagcctacgacgcgcgatcgagcccgggccattgctgacctcgagttaagttgcgcgaggagaggcgcttcattccagcagggatccttctcgtgagcccagtcgatctgaccgtccttggtatctgggggggttgttctgcactctctctttaatttgtgagccgtgacaggttcttgaagcgcaattgctaagagttttagttgtagaggaagagaaagatttgctaatatggcgttggcagggacctccaaagtagtgctgagatgtatcgcctttgggattttctgcgagatggccgtcttccccaccgtccc

SEQ ID NO: 35195 - DNA, 727 bp, Zea mays
  misc_feature: Ceres CLONE 1414370-F
  misc_feature: Encodes the peptide sequence at SEQ ID NO. 35196
  misc_feature (463)..(463): n is a, c, t, g, unknown, or other
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaactctccccaccggctaaccctagcagcggcacgcgggcgacggcgaccagtagagggctagtcgcgccaccggcgaagggattcagcggtctacccgtcctccgacacaggcgcggcggcgtcctgcagattattattggtttgttgcaaaatgtctacggaagtgactttgaacaattctggtggttctgaatctgcattgctgttactggaacagcttgctgaagtttttggaaagttgaaaactcacaccgaaacatttctgcaattgcaaaatggcataaaatgggaagatatttgagggcatttcctcagccttgatgagtcgtacagaaagcagtttgatgaactggtagagaanggagaggcattanaagaaaagaagctgaagcttgtaaattgattgcagagaaagaggctaagtttctacaaaagagcatgcctcactgaatcagcttcaggagctaagggatgctgctggctctccccagcagaaggtcgacaaaatttaaggtggaacttgctgaaatcctgaaacaggggaagcaagcacaaaaggtaagtccctcatcattgccacaatgctttccggctctcaaggaaaatcccctggttaggggcgggg

SEQ ID NO: 35196 - protein, 49 aa, Zea mays
  misc_feature: Ceres CLONE 1414370-F
MSTEVTLNNSGGSESALLLLEQLAEVFGKLKTHTETFLQLQNGIKWEDI

SEQ ID NO: 35197 - DNA, 727 bp, Zea mays
  misc_feature: Ceres CLONE 1414373-F
  misc_feature: Encodes the peptide sequence at SEQ ID NO. 35198
  misc_feature (537)..(537): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatccaatcgaaaaccctttccaaatccgtctccgccctcacgcacgcggcccaactagcctaacaaaccctagctagatttagaaaaaaaatttgtccccaatccgaaccgacgaggagctcgccgccgtgagatgtccgagtacgacgagcgctaccagggcaacggcgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatgacagtggttcctcgaaatctcgagaaagggaccgagaacgcgataagggcaaggatagggagcgtgacagggatcgtggccgagaaaaggggagggaccgagacagggataaggatcgtngaaagagtgacagagacagagatcgcgatcgccaccacagggaccatcgagagcgcagcgagaaaagggaacaccgtgatcngtctgatgatcgtgaccgtcacgtgatggtcgggaccgccacgtgatgatcgggattctaaagaaaaaaatcgggacaaaatgccctcgaagcatcgctcccgtcccc

SEQ ID NO: 35198 - protein, 147 aa, Zea mays
  misc_feature: Ceres CLONE 1414373-F
  misc_feature (106)..(106): Xaa is any aa, unknown, or other
  misc_feature (133)..(133): Xaa is any aa, unknown, or other
MSEYDERYQGNGDMPAAEGGYPQAEYAAAAAPAAGGSPPADSKPSGFSDHADGRSSQHQHETQSHDSGSSKSRERDRERDKGKDRERDRDRGREKGRDRDRDKDRXKSDRDRDRDRHHRDHRERSEKREHRDXSDDRDRHVMVGTAT

SEQ ID NO: 35199 - DNA, 715 bp, Zea mays
  misc_feature: Ceres CLONE 1414379-F
  misc_feature: Encodes the peptide sequence at SEQ ID NO. 35200
  misc_feature (540)..(540): n is a, c, t, g, unknown, or other
  misc_feature (541)..(541): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaatccaatccccgggccaccactacctgcctgcccgtgcccacgcttcttctcttctcctccccaagccccagccccagccccagctaccgcgccccctcctgtctgttccaccagcgtcggcctagctacctgcccgtcccctctccgagtacggtcggaagcctcagctgaaggatctggcctgggcgccctccggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactcccacttcccgcatggtgcacccctttggcgacgtcccaaggcagacnntccaagcattcctgtattctggtaacccgcagcacctctgccatccgtacagtcagctccggatgcccatgtcctgccgcagcgccgttacaccgtgaggtctcagtctcactccgcaattatgctggntctcagaacatgagactcacaggaggacccgctggagtcctgggg

SEQ ID NO: 35200 - protein, 52 aa, Zea mays
  misc_feature: Ceres CLONE 1414379-F
  misc_feature (21)..(21): Xaa is any aa, unknown, or other
MADTPTSRMVHPFGDVPRQTXQAFLYSGNPQHLCHPYSQLRMPMSCRSAVTP

SEQ ID NO: 35201 - DNA, 987 bp, Zea mays
  misc_feature: Ceres CLONE 1414380-F
  misc_feature (5)..(5): n is a, c, t, g, unknown, or other
  misc_feature (6)..(6): n is a, c, t, g, unknown, or other
  misc_feature (565)..(565): n is a, c, t, g, unknown, or other
  misc_feature (649)..(649): n is a, c, t, g, unknown, or other
  misc_feature (756)..(756): n is a, c, t, g, unknown, or other
  misc_feature (864)..(864): n is a, c, t, g, unknown, or other
  misc_feature (865)..(865): n is a, c, t, g, unknown, or other
  misc_feature (941)..(941): n is a, c, t, g, unknown, or other
  misc_feature (964)..(964): n is a, c, t, g, unknown, or other
ccccnncccccccccccacacctttatcgggcgttctttactttttcaaactggagctccccgcggtggggggcgctcttttcctagtggatcccccgggctgcaggatattcgcacgagaccattacctagaacatcctaatcaaaaaagcagaagcagcatcacgatcccggcccggcggcgcgtacgtcgacgaggaggaggaggacgtacgtacgcagagcagctgctggcaccatggctcccgtgagaatcaacgctgttccgttcctcccgacggcggcggaggaggagacgaagctgcgcgcgtcgttgcgcgagaggaggacgagcgccccaaggagccgcgagaccgcttcagcgaggacgcgccccgtggggtcgcatcaaggtccatacaacagagctcgtcatgtccgagatccagcgcgcgactggcccacgacctggagacggagcggggccatccctccccggatggagcgaccccaccgccctgggactgttgtcgccccagtgcccccgaaacatccgtctccgcccttctgcgtagggcgaactagngttccgagagcctcccagccgccgcggactcgtcatacctcacggccgcgcggttgggccaccgtggtagaggcgggagggccntcgccgcacgcggcatccgaggccgccgcgtttcaggggccgctcggaggacagtcccttacagcacgtcagaggccggtaggcacaaggcatcattgactgtctgntgctcgcaggatttcctatgcaccagcaacacaccgaagcatagaccgttcctgggaggaaaggccggcaacgaggtaatatcgtggacgacgtggggcggcggagannaaataactagcatattcatacacaattcgcgagacgagcgctctatgtacacccatgcaacaaggcactcctccanacgacgcagggacccgggctgtntggtgagccgccgccgccccgag

SEQ ID NO: 35202 - DNA, 682 bp, Zea mays
  misc_feature: Ceres CLONE 1414385-F
  misc_feature: Encodes the peptide sequence at SEQ ID NO. 35203
aaagctggagctccccgcggtggcggccgctctataactagtggatcccccgggctgcaggaattcgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtggcggggcgaggctgggacgcgccggcgtgccgccaccgccacaagcctcacaaggcgaaccaggccgagtgggaggccatcgggcgcgtccgcgccgccgcgggccgcgtcggcctggagcacttccgcctggtgcggcgcctgggcagcggcgacctcgggaacgtctacctctgccagctgcgcgagccctggtccaccacggggtgcctgtacaccatgaaggtggtggacaaggacgcgctggcgttccgcaaaaaactgccgcgcccggaggtggagcgcgagatcctccgggggatcgaccaacccttcctccccacattgtacgccgacttccaaggcgcccactaccccg

SEQ ID NO: 35203 - protein, 161 aa, Zea mays
  misc_feature: Ceres CLONE 1414385-F
  misc_feature: SWISSPROT Homolog: EC 2.7.11.1 Non-specific serine/threonine protein kinase
MATIREESDYDSSRSSLTAPGGSRRSWISDIGSASSVSARSVAGRGWDAPACRHRHKPHKANQAEWEAIGRVRAAAGRVGLEHFRLVRRLGSGDLGNVYLCQLREPWSTTGCLYTMKVVDKDALAFRKKLPRPEVEREILRGIDQPFLPTLYADFQGAHYP

SEQ ID NO: 35204 - DNA, 752 bp, Zea mays
  misc_feature: Ceres CLONE 1414386-F
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (19)..(19): n is a, c, t, g, unknown, or other
  misc_feature (48)..(48): n is a, c, t, g, unknown, or other
  misc_feature (49)..(49): n is a, c, t, g, unknown, or other
  misc_feature (441)..(441): n is a, c, t, g, unknown, or other
ttggccccccccnntnccncgctggggcacaccatccccccgcgcccnnccccaaagctggagctccccgcggtggcggccgctctagaactagtggatcccccgggctgcaggaattcgcacgagaccattacctagaacatcctaaaaaatctactccaggcgaactgtcgcatccgccgccgcggccaccgcggcctcgccctcgccggcaggagggcacggccgccgccctttgcgctacgccgtcctcggcgccggatttgcgggtctctccgtcgggtggcacctcctcaaggtcaccctccacttcccctcttccttctctcccggtgtactgtgacaagaaaaatcggctgaatcgaccctggcgcgatttcaatggtcagcatagcccgagggattcccgggtgtcagtggacatctaccacgagaacgganacagcggaggcgcgtcgggcggctcgggtggacttctccatccctactcgcctaaagtgaagctttttctggaggggtgctcagctctggagaagagaggatgggatccccttcccagcggccgagcaagcaaaagggaacccccggcaatcaacatacccctaggccaaggacgaaaaaaccttaccctggaaaaagggcgcatcggacccaacccgcctaaccacctggaaaaaagctggccgccccactattgcctgagaaagcaacatggttggctattggaaaatttatggcacagacatgccccg

SEQ ID NO: 35205 - DNA, 670 bp, Zea mays
  misc_feature: Ceres CLONE 1414388-F
  misc_feature: Encodes the peptide sequence at SEQ ID NO. 35206
aaagctggagctccccgcggtggcggccgctctagaactagtggatcccccgggctgcaggaattcgcacgagaccattacctagaacatcctaatcgaaaactccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatggtacgtggtgctgtgccatcaccaacatctactgcacctgcagccaaccaagaacctaccactgctgctcctgccagttccccggcaacaggattgggtggtttgttgcaaagtctgggtactacaggcgctgctgctaacagtgaggggttgggtttgtttggatctgccccccctggattagaccaaatgcaacaacagctagctga

SEQ ID NO: 35206 - protein, 154 aa, Zea mays
  misc_feature: Ceres CLONE 1414388-F
  misc_feature (22)..(90): Pfam Name: ubiquitin Pfam Description: Ubiquitin family
MGGGDADAGGEPADAQATLHIRCTNASKFTVRADLGATVGAFKAIVADSCDVPAPQQRLIYKGRILKDEQTLASYGVETDHTIHMVRGAVPSPTSTAPAANQEPTTAAPASSPATGLGGLLQSLGTTGAAANSEGLGLFGSAPPGLDQMQQQLA

SEQ ID NO: 35207 - DNA, 764 bp, Zea mays
  misc_feature: Ceres CLONE 1414398-F
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
tttgggttnttttnnnnntnnctcccaactcccccgccagcggggaataataaattcaaagctggactccccgcggtggcggccgctctagaatagtggatcccccgggctgcaggaattcgcacgagaccattacctagaacatcctaatcgaaaaacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctacctttgtgagggacttgggcaggaaagcacgccataactcttcattctctgccacctctttggatgacttcgaagctcaagagtacacgtatctccaccgtcgtgcttttcgcacaatgggggttcgacaggggcgggctccaaccggccttcctaaaaaacccatcccccgggggagaaagggtggaagatttttacaccccctctccgacccccttttggtgggcccacaatttttttttttacgcgggccaagggaaaaaacaaagtggcccccccccgggggggcctatacccccccccccccccctatccggtaccaaaaacaacaggggcgccaaaaa

SEQ ID NO: 35208 - DNA, 672 bp, Zea mays
  misc_feature: Ceres CLONE 1414400-F
  misc_feature: Encodes the peptide sequence at SEQ ID NO. 35209
tccccgcggtggcggccgctctagaactagtggatcccccgggctgcaggaattcgcacgagaccattacctagaacatcctaatcgaaaagagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctggcgtaggagattgtattccgtctgattaatcggcggagagcaagcgggtgttgcggctgcgcgagcatggcggccgaggaggctgcggagggcagcggaaccaggaggcacatggatctaaacctgtatctcggcctccctccattgccgcggcctccagtctggctggacccgacgttgatgcccaacttgaccggtgctgcgccagaatcctcaataactggcgagcctgaggaaccgttggccctgggggcggcagcctattctcccgtgaaagcactttccacccccggaggagcctccaatgcttggatcccctaattctattcctg

SEQ ID NO: 35209 - protein, 84 aa, Zea mays
  misc_feature: Ceres CLONE 1414400-F
MAAEEAAEGSGTRRHMDLNLYLGLPPLPRPPVWLDPTLMPNLTGAAPESSITGEPEEPLALGAAAYSPVKALSTPGGASNAWIP

SEQ ID NO: 35210 - DNA, 676 bp, Zea mays
  misc_feature: Ceres CLONE 1414401-F
  misc_feature: Encodes the peptide sequence at SEQ ID NO. 35211
aagctggagctccccgcggtggcggccgctctagaactagtggatcccccgggctgcaggaattcgcacgagaccattacctagaacatcctaatcgaaaaatcagacgaccaccttcctgcccccattcgtttccgcatcggcgtatctcccggcggcaaaggcgctctcctcccgacctccctgcggtgccggtacgacagtcgacaggatggcaatggccacatcagcatcgtaccctccacctcctccattttaccgattgtacaaaaaatttgagcaagatccctcatctgcaccagaacctccaccaccaattgatgaaccattcaaagccttgggtgttgatgctgccgagggcgagcctgagtctggcagtgaaggagagtattcaggttcggatgatgatgagcaggagccggaggatgactcgaaagaggcagataaggcaacaggtaagattgcgattgcgcttcagaaggctgtgccggggcccaaggttaatccttttgacgataagccgaagatgaaatttggttttgatgaggaggatggctcaggcacccgagaccaggagaagaatgagttgaccaagaagatgggaaaggatgtgaaggcagcagaggcaaagaggtcagcattggagaagcttgatgaaggaggaggagaaggccaa

SEQ ID NO: 35211 - protein, 155 aa, Zea mays
  misc_feature: Ceres CLONE 1414401-F
MAMATSASYPPPPPFYRLYKKFEQDPSSAPEPPPPIDEPFKALGVDAAEGEPESGSEGEYSGSDDDEQEPEDDSKEADKATGKIAIALQKAVPGPKVNPFDDKPKMKFGFDEEDGSGTRDQEKNELTKKMGKDVKAAEAKRSALEKLDEGGGEGQ

SEQ ID NO: 35212 - DNA, 688 bp, Zea mays
  misc_feature: Ceres CLONE 1414407-F
  misc_feature: Encodes the peptide sequence at SEQ ID NO. 35213
aaagctggagctccccgcggtggcggccgctctataactagtggatcccccgggctgcaggaattcgcacgagaccattacctagaacatcctaatcgaaaactctattacaatagccaggggactcgctcctctctaggcaggtactccactccatccatccatcatcgcctatccgtgaacaccttgcaggaggagagggcggcgttggcgccgtcgcctgcggccctaggaatagagataggacggcgtcgagaatgatccggagcaggtgatggatgaggatgacgctgaggatgaggaggatctgcaggaagagcatcacacaagaacaattaggacgtcgaccaagacggcggaagcatcgtcatcagtggagcggcgggtgccggcgtggtggaggcgacgccgcacgcacaagcggttgtccaccataggtgttgacctggtcatcgccggtatcctcgtgctggacttgctcgtcgtcgtcggcggcggcagggacaccagtcgtcgtcgctggatccacctcgactatgcttcgccctttctgcctagccggcggcgggggtggacgacttgaagcattgatcaatggcctcccatcacacgtgcctttcacccgaagggggacctcggtgcccatagcctttcagctgccgaaggaagacggcctcggcatgtcccc

SEQ ID NO: 35213 - protein, 102 aa, Zea mays
  misc_feature: Ceres CLONE 1414407-F
MDEDDAEDEEDLQEEHHTRTIRTSTKTAEASSSVERRVPAWWRRRRTHKRLSTIGVDLVIAGILVLDLLVVVGGGRDTSRRRWIHLDYASPFLPSRRRGWTT

SEQ ID NO: 35214 - DNA, 677 bp, Zea mays
  misc_feature: Ceres CLONE 1414408-F
  misc_feature: Encodes the peptide sequence at SEQ ID NO. 35215
  misc_feature (26)..(26): n is a, c, t, g, unknown, or other
  misc_feature (27)..(27): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (53)..(53): n is a, c, t, g, unknown, or other
  misc_feature (54)..(54): n is a, c, t, g, unknown, or other
aagctggagctccccgcggtggcggnngttaatggctaacggatannnngggnntgagtatttcttacccgaccattacctagaacatcctaatcgaaaagagcagcagaccacgacccccacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtaccagtagaaggaacacacccagtccgcccgtgactacgagtgaatttgttgggtgtggtgtttgttgaggtcacgatgatgggaggcgcgctgttggtggatcagagcgtggtgttccctggcgtccacaacttcgtggatctcctgcagcagaacggcgacaagaacctgggcttcgggtctctgatgccgcagacgtcctctgccgaccagtgcgtgatgggggagggcgatctcgtggacccgcctccggatagcttcccggacgccgggggaggacgacggcgactatgacgtcgaggacatcgaggagctggagcgccgcatgg

SEQ ID NO: 35215 - protein, 72 aa, Zea mays
  misc_feature: Ceres CLONE 1414408-F
MMGGALLVDQSVVFPGVHNFVDLLQQNGDKNLGFGSLMPQTSSADQCVMGEGDLVDPPPDSFPDAGGGRRRL

SEQ ID NO: 35216 - DNA, 666 bp, Zea mays
  misc_feature: Ceres CLONE 1414409-F
gctctagaactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacggaggagtggaaaccgcgccggggatcgtggcgaggggggacccccttcaggggttctggtcggggggtccgggtctcctttcttcgggttggagaaattgggaaaggggtttccgggggaaacccgcccgccttaccgaatctggcccccaaggtgcagaaaggccccccggggtttttttttttcttggggggcgggcggaccgggggggggaaaattttggtgtttttttttcttcgggggggggggggggctgatacgcccgcacaggtttttgccttcccttctctttgttccttgggcggggtggggagggaagaggcgggagggaggtggttattgtctgctttgttttgggggcccgcgttttggtcctccctcctcccctccc

SEQ ID NO: 35217 - DNA, 673 bp, Zea mays
  misc_feature: Ceres CLONE 1414416-F
  misc_feature: Encodes the peptide sequence at SEQ ID NO. 35218
  misc_feature (599)..(599): n is a, c, t, g, unknown, or other
  misc_feature (619)..(619): n is a, c, t, g, unknown, or other
  misc_feature (657)..(657): n is a, c, t, g, unknown, or other
  misc_feature (667)..(667): n is a, c, t, g, unknown, or other
aagctggagctccccgcggtggcggccgctctagaactagtggatcccccgggctgcaggaattcgcacgagaccattacctagaacatcctaatcgaaaaaattgtaaactgtgatcttccaggctgcaccaactccatctccaggtggaatggagttagcttgcctgcacactcagtcacggtggcgtccctataaggcgtaggcctgacgtcacccacgccctcgcctcgcacggggcggcgcggcggccggcggagggaatggcgaggcgaagcagaggcagcggcagcgtcacggacgcggcgtccaaggcggacgcggcgacgatgcggatggtgtcccgcaggggcgccgtgcggctggtgctcgtgtcggccaccgcctgggccatgctcgggctcgtcgcgctcgccttccacctccggacatgcagctcccgcgtcgcattcctctcagctctttgcaaaaaagacagtaaagttctctctgtgttggactcgatggggctctcatccaaaccactccaccgctgcccgatacctgttgcggatgatccatatgttgttgtcataccaaagacgactcccaacacattngtgaagaaagtgacatatantactgttgacaaacaggatagagatccctcaccgctgnttggagaccnaaaaag

SEQ ID NO: 35218 - protein, 136 aa, Zea mays
  misc_feature: Ceres CLONE 1414416-F
  misc_feature (112)..(112): Xaa is any aa, unknown, or other
  misc_feature (119)..(119): Xaa is any aa, unknown, or other
  misc_feature (132)..(132): Xaa is any aa, unknown, or other
  misc_feature (135)..(135): Xaa is any aa, unknown, or other
MARRSRGSGSVTDAASKADAATMRMVSRRGAVRLVLVSATAWAMLGLVALAFHLRTCSSRVAFLSALCKKDSKVLSVLDSMGLSSKPLHRCPIPVADDPYVVVIPKTTPNTXVKKVTYXTVDKQDRDPSPLXGDXK

SEQ ID NO: 35219 - DNA, 518 bp, Zea mays
  misc_feature: Ceres CLONE 1414418-F
  misc_feature: Encodes the peptide sequence at SEQ ID NO. 35220
  misc_feature (266)..(266): n is a, c, t, g, unknown, or other
  misc_feature (301)..(301): n is a, c, t, g, unknown, or other
aaagctggagctccccgcggtggcggccgctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggcgacagctcctcctcctcctccttgcgccccaccaacacctcgttcgactcctacgagttcgacttcggnatgaactcctcccgatctaccgatctgcccctcgngacagcggcgggcgcggtaccaacatccacgagcccgcaccgggccagtgatgcacagccggcagggacaatcgtcgagaacaacaacctttccccgccgggggggtggggcccacaatgggggggcccctgaatccgggccaaacccccaggggtgggaaaaatttatttgggcgcggaggggggggcccccccgggggggccccccctttttggg

SEQ ID NO: 35220 - protein, 84 aa, Zea mays
  misc_feature: Ceres CLONE 1414418-F
  misc_feature (41)..(41): Xaa is any aa, unknown, or other
MSSYSGDSSSSSSLRPTNTSFDSYEFDFGMNSSRSTDLPLXTAAGAVPTSTSPHRASDAQPAGTIVENNNLSPPGGWGPQWGGP

SEQ ID NO: 35221 - DNA, 637 bp, Zea mays
  misc_feature: Ceres CLONE 1414421-F
  misc_feature: Encodes the peptide sequence at SEQ ID NO. 35222
  misc_feature (475)..(475): n is a, c, t, g, unknown, or other
  misc_feature (485)..(485): n is a, c, t, g, unknown, or other
  misc_feature (489)..(489): n is a, c, t, g, unknown, or other
atagctggagctccccgcggtggcggccgctctagaactagtggatcccccgggctgcaggaattcgcacgagaccattacctagaacatcctaatcgaaaaaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccttacccggcggttcctcagcagcccgcagctgtcgctcaaggagctcccgctgctctcttcctgcctcccctccgcgccgntctcccacgncganagggactggatggacgagtacctcctcgaggccaagcaggcgctcgggtacccgctcgcgccctcggagacgctcgccgaagcgatgactgccccgcgcgtcatttcgatgtgctgttctactcgcgttccagcatctggacccttct

SEQ ID NO: 35222 - protein, 166 aa, Zea mays
  misc_feature: Ceres CLONE 1414421-F
  misc_feature (113)..(113): Xaa is any aa, unknown, or other
  misc_feature (116)..(116): Xaa is any aa, unknown, or other
  misc_feature (117)..(117): Xaa is any aa, unknown, or other
MGPPAMAFQALTLTPLPFSLHSSSRRVRVLAVAADQTPPPAPPSEPANSPSRLLRELAQRKKAVSPKKKHPPRRFILKPPLDDERLTRRFLSSPQLSLKELPLLSSCLPSAPXSHXXRDWMDEYLLEAKQALGYPLAPSETLAEAMTAPRVISMCCSTRVPASGPF

SEQ ID NO: 35223 - DNA, 870 bp, Zea mays
  misc_feature: Ceres CLONE 1414425-F
  misc_feature: Encodes the peptide sequence at SEQ ID NO. 35224
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nnnncccccccnnnnnnnnnnncnnnncaccnnnnnnncngctgtnnnttctcaaaagctggactccaccgcggtggcggccgctctatcactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacgaggcctccccggtgcgcggcagcggccaaactatgtacctggcgcccggactgccgggcgcacacggccgtcgggggggaaatttcgggggcggcggccgaaagcaacaactttcccacacccgcgccgttcccgggcccgcgggagggaccccccggccccaaataactccgccacaagggccggccagtcgaacgacattgtatgtacccgcgcccggggggaaaaagggggtctggaacgggcgccccttttcacaatcgggggccccctcccattcttctccccctcgttgccagccgccaccagaaagcgcggcgtaagaccctttcccggtgtccccagggaaggaacgagacgggggggggccccacaccgcggggaccacccgccgaccccctttgccaggggacaagcggccgcgcgcccaaaataggacagcaaggagagaatccccacacgacaacccccagggtcgggagtataacaccgcgcgccgaagaagtatccccttaatgtagaccccccacgggggcg

SEQ ID NO: 35224 - protein, 143 aa, Zea mays
  misc_feature: Ceres CLONE 1414425-F
MAPRTLGFNAAPLLQILRSLCLLALAAAAAVSGRRHEASPVRGSGQTMYLAPGLPGAHGRRGGNFGGGGRKQQLSHTRAVPGPAGGTPRPQITPPQGPASRTTLYVPAPGGKKGVWNGRPFSQSGAPSHSSPPRCQPPPESAA

SEQ ID NO: 35225 - DNA, 773 bp, Zea mays
  misc_feature: Ceres CLONE 1414427-F
  misc_feature: Encodes the peptide sequence at SEQ ID NO. 35226
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (586)..(586): n is a, c, t, g, unknown, or other
nggcgccccccnnnnnnncnnggnacaccgcgcccaccacacaannncatacacgctgggactccccgcggtggcggccgctctataactagtggatcccccgggctgcaggaattcgcacgagaccattacctagaacatcctaaaaaaaaaccccgaccgcccatgtccgccatcgcggcctcctcggccgccgccgccgcggcgtcgaactccgatgaggaagaaaactatgaggagtacatcccagtcgccaagcgccgggccatggaggccgagcgcctccgccagctccgcctctccaagtcggcgccggcctctgccgtctcatcactcccgatgccacctcccccgcctcttttgccagcgcagacctccgttcccgacgccgccgcgaagcccagccttctcgtcaaggccacgcagcttaagcgcgcggccccggaggtgaccgccacggagcagcgcatccagcaggagaaggaagtgattgaaaatctctcagacaacaaatcgctcaggtcagtcccgcgagatcgccaagggcatcatctacacggaaccgatcccagaccgggtggaaagncgcccctccgcctcccgccgcatgcccgctcgccaaaagccaacgaagttcccggcgcaaaggggcaacatcatccggtcgacggggggacgaatattaccgccccccctggagcggggaatttcccggggaatccttccgcccctcccccggaaagccccaatggctttccgggaaaagccttgcg

SEQ ID NO: 35226 - protein, 202 aa, Zea mays
  misc_feature: Ceres CLONE 1414427-F
  misc_feature (141)..(141): Xaa is any aa, unknown, or other
MSAIAASSAAAAAASNSDEEENYEEYIPVAKRRAMEAERLRQLRLSKSAPASAVSSLPMPPPPPLLPAQTSVPDAAAKPSLLVKATQLKRAAPEVTATEQRIQQEKEVIENLSDNKSLRSVPRDRQGHHLHGTDPRPGGKXPLRLPPHARSPKANEVPGAKGQHHPVDGGTNITAPPGAGNFPGNPSAPPPESPNGFPGKAL

SEQ ID NO: 35227 - DNA, 676 bp, Zea mays
  misc_feature: Ceres CLONE 1414440-F
  misc_feature: Encodes the peptide sequence at SEQ ID NO. 35228
aagctggagctcaccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttcaccagggcgactaccacctccgcctccgcaagctcgtcca

SEQ ID NO: 35228 - protein, 140 aa, Zea mays
  misc_feature: Ceres CLONE 1414440-F
  misc_feature: SWISSPROT Homolog: EC 1.14.13.93 (+)-abscisic acid 8'-hydroxylase
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFTRATTTSASASSS

SEQ ID NO: 35229 - DNA, 831 bp, Zea mays
  misc_feature: Ceres CLONE 1414444-F
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (21)..(21): n is a, c, t, g, unknown, or other
nnccccccccnnnnncccccncgcccccccccccccccgggctgcgcaccaaagctggagctccaccgcggcggcggccgctctagaactagtggatcccccgggctgcaggaattcgcacgagaccattacctagaacatcctaaaaaaaaaaaccaaaaccctccatccattctacacgcgccgccgcactcctgtacacgccccgccgccaccgcctccacaaccacagcgcgcaggaatccctcgttctcgcagagggtttcaggcgtcgtatgtaagagaagatggcgctctcagtatccatggacggcatcgatggcgtgggcgcgaaatcctcgatttgaacctctccgctggcgacctgagactccatcaccctcccggccggcgaggactgtccgcatcactcagagatgaccgcaggaggtaacttccgtgggtggaggatccttcccaagcaacctccgatacggcctcgccccaacattattgctcggggacaaatcctgcccaagttgttccctcccagaacaagtttgccgaaggcttgcaaaacatggccttaccgcaggaatcctacccgcgcccaaacttgggagccagaaaaaaaggaaaaattggctctaatgggatgacctggaacaccccggcacgacgtaataacaccaatatggggcttactgggcttcactggaccaatcagaaaccccctcaacggaacggtgcagcccgcatatagcggaagaaccacaaccatggggggaactaaccccctgatcaaggccccacacccactttgaagggtcgacgccgggccccacaagaatt

SEQ ID NO: 35230 - DNA, 714 bp, Zea mays
  misc_feature: Ceres CLONE 1414449-F
  misc_feature: Encodes the peptide sequence at SEQ ID NO. 35231
aagctggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggtgtcgacggcctcccgccggggcctccgggttgggcggtggtggggaacctgttcccaggtgatcctgcagcgactggccttcatgtacgtggtgcgcgacctccgggaagaagtaccgggccatcttccacatgcggaatggggcagcgcaccctcatcggggtcaccccgggggagcttatccccgggagggctggggaaaaaaggccccctggtcccgaagcggcccagggaaccccccacccccccccttttatgggggggaaggggaccggtaaatttggggcccataaggccctgggggggggggttgggacacaatatttttttccaaaaaatggtccccccccccccgcaaagggttttttccggttcccggagagggcccgggacgccgatatttgccc

SEQ ID NO: 35231 - protein, 162 aa, Zea mays
  misc_feature: Ceres CLONE 1414449-F
MDVNDVLLVVLAAALAAMWWRRCSKTGVDGLPPGPPGWAVVGNLFPGDPAATGLHVRGARPPGRSTGPSSTCGMGQRTLIGVTPGELIPGRAGEKRPPGPEAAQGTPHPPPFMGGKGTGKFGAHKALGGGVGTQYFFPKNGPPPPAKGFFRFPERARDADIC

SEQ ID NO: 35232 - DNA, 683 bp, Zea mays
  misc_feature: Ceres CLONE 1414451-F
  misc_feature (633)..(633): n is a, c, t, g, unknown, or other
aaagctggagctcaccgcggtggcggccgctctagaactagtggatcccccgggctgcaggaattcgcacgagaccattacctaaaacttccaattcaaaaaacaacccttgtagtctcagtcaatctgtagattgaaactacgatgagactgtgaccgctcgactcctcctccccgcctgtcgcggctgcggctgctgttaccgaggggcccctcgcccaggtgttccacttccaccccagcgaccaggagctcgtctcctactccctccgccgccgcggcctcaggcgccgcctcaacgtctaccgcttcgccgacatcaaccgctaccgcctcaagccctgggacctccactcaatctcccgcatccgcaggcgctacaccaagtggtacttcttcgcccgtctcgacctcaaggtcgccggcgctagcgccgggggctggggagatactgttcgaggacaaaccgcgactactactaggggatactggaataccacggtcaaggaccgtcaagagcaccaccgtagtaagccagacgggatgtaaaacaccctcgtcttccactccgtgaggcctgctaagttcgagaggaccaactgtgccttggactagaacagcctctgcgatcancactcacctcaggatctgcacgagagttgcagaacctacccaaaagatgg

SEQ ID NO: 35233 - DNA, 694 bp, Zea mays
  misc_feature: Ceres CLONE 1414454-F
  misc_feature: Encodes the peptide sequence at SEQ ID NO. 35234
  misc_feature (247)..(247): n is a, c, t, g, unknown, or other
  misc_feature (270)..(270): n is a, c, t, g, unknown, or other
  misc_feature (274)..(274): n is a, c, t, g, unknown, or other
  misc_feature (280)..(280): n is a, c, t, g, unknown, or other
  misc_feature (281)..(281): n is a, c, t, g, unknown, or other
  misc_feature (400)..(400): n is a, c, t, g, unknown, or other
  misc_feature (406)..(406): n is a, c, t, g, unknown, or other
  misc_feature (414)..(414): n is a, c, t, g, unknown, or other
  misc_feature (426)..(426): n is a, c, t, g, unknown, or other
aaagctggagctccccgcggtggcggccgctctagaactagtggatcccccgggctgcaggaattcgcacgagaccattacctagaacatcctaatcgaaaagcgacacacccaaaggcctctccctcccgtcccgtgtcccgatcgcaccgcaccgcaccgctccccacgatggcgtcgcacatcatcctgccgccggacgacgccgacgagaaccacaccaccagacggcggcgcggggcgccgncggaagaagaagaagaaaagcgnaagnagctgnngcgcgacgaccacaacgacgagcacggggtggcaccgggcgctgccgcccaagggggggcttgccggttctcggcacgtggggtgcggatcttcccgggaatcgtaaccccaaactccngttcgntccgaaangaatccctccgnaagccttggttgaaggccgccaaagtcaagaactctcgagaggccgattttgggatacgcccccccaaaaaaggggcgggatttaaccgagaaacctccccgaaattcccaattattccaaatccccttaaagaaatctccccggccaatcaaatgggaaagaaaaatattttgcgaaaggaaaaaggaacccgttcccccaaaaggggggtgggttcaaaaaaaaacagcggggggggggggtgcctttctccggggggggggggcc

SEQ ID NO: 35234 - protein, 174 aa, Zea mays
  misc_feature: Ceres CLONE 1414454-F
  misc_feature (26)..(26): Xaa is any aa, unknown, or other
  misc_feature (35)..(35): Xaa is any aa, unknown, or other
  misc_feature (37)..(37): Xaa is any aa, unknown, or other
  misc_feature (77)..(77): Xaa is any aa, unknown, or other
  misc_feature (79)..(79): Xaa is any aa, unknown, or other
  misc_feature (81)..(81): Xaa is any aa, unknown, or other
MASHIILPPDDADENHTTRRRRGAPXEEEEEKRKXLXRDDHNDEHGVAPGAAAQGGACRFSARGVRIFPGIVTPNSXSXRXESLRKPWLKAAKVKNSREADFGIRPPKKGAGFNRETSPKFPIIPNPLKEISPANQMGKKNILRKEKGTRSPKRGVGSKKNSGGGGCLSPGGGG

SEQ ID NO: 35235 - DNA, 751 bp, Zea mays
  misc_feature: Ceres CLONE 1414459-F
  misc_feature (354)..(354): n is a, c, t, g, unknown, or other
  misc_feature (355)..(355): n is a, c, t, g, unknown, or other
  misc_feature (365)..(365): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (604)..(604): n is a, c, t, g, unknown, or other
  misc_feature (616)..(616): n is a, c, t, g, unknown, or other
  misc_feature (617)..(617): n is a, c, t, g, unknown, or other
  misc_feature (633)..(633): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
  misc_feature (639)..(639): n is a, c, t, g, unknown, or other
  misc_feature (643)..(643): n is a, c, t, g, unknown, or other
  misc_feature (644)..(644): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (664)..(664): n is a, c, t, g, unknown, or other
  misc_feature (665)..(665): n is a, c, t, g, unknown, or other
  misc_feature (668)..(668): n is a, c, t, g, unknown, or other
  misc_feature (670)..(670): n is a, c, t, g, unknown, or other
  misc_feature (675)..(675): n is a, c, t, g, unknown, or other
  misc_feature (721)..(721): n is a, c, t, g, unknown, or other
  misc_feature (750)..(750): n is a, c, t, g, unknown, or other
aaagctggagctccccgcggtggcggccgctctagaactagtggatcccccgggctgcaggaattcgcacgagaccattacctagaacatcctaatcgaaaagagtccagctcggcaggtcagtcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtccctcgcgtgctggcgctcgtcgcccgcgcgcccgcgccgnntcaggcgagnagnnnnnnnnnnnnnnnnnnnnnnnnnnngnannnnnnnnnctnnnncnnnnnnnnnnnnnnnnnnnnnnnnnnnnnnnnnngnnnnnnnnnnnnnnnnnnngnnnnnnnnnnnnnnnnnnnnnnnnnnnnnnnnncnnnnnnnnnnnnnnngnnnnnnnnnnnnnnnnnnnnnnnnnnnncnnnnnnnnnnnnnnnnnnnnnnnnnnnnnnnnnnnnnnnnnnccccccccnnnnccncccccccccccnnccccccccccgccccncnncnncccnnccccccccccggnnnccccnnggncnccccnccccccccccccccccccggggcgcggggggcgcgcgccccccccncccgcgcgggccccggcgcgcccgggggng

SEQ ID NO: 35236 - DNA, 501 bp, Zea mays
  misc_feature: Ceres CLONE 1414461-F
  misc_feature (225)..(225): n is a, c, t, g, unknown, or other
  misc_feature (326)..(326): n is a, c, t, g, unknown, or other
  misc_feature (327)..(327): n is a, c, t, g, unknown, or other
  misc_feature (336)..(336): n is a, c, t, g, unknown, or other
  misc_feature (347)..(347): n is a, c, t, g, unknown, or other
  misc_feature (354)..(354): n is a, c, t, g, unknown, or other
  misc_feature (438)..(438): n is a, c, t, g, unknown, or other
  misc_feature (491)..(491): n is a, c, t, g, unknown, or other
aaagctggagctccccgcggtggcggccgctctagaactagtggatcccccgggctgcaggaattcgcacgagaccattacctagaacatcctaatcaaaaacaacagaacaacctacccccacaagcagaaggatccgggcggccaccgagagtcactgggaagaagctcgtccggcgcccccgcgaacgagacgacggcctccttccttccgctccgctgaangaacgacctcccccgttttaaaaaaaaaggcgggaaccgctcccccaaaaagggcccaaaaaaaagagagggggggggccttggccttttttggtggcggnnggggggggnttggtgggggnccccccnccggggaaaattcccgccccccccccccggggggggggggggcgcccccccccccccccccccaaaaaggggggcccccccttntttttgtgggggcgggcaaaaaaatttttttttttttttttcaccaccccagnaccccccggc

SEQ ID NO: 35237 - DNA, 725 bp, Zea mays
  misc_feature: Ceres CLONE 1414464-F
  misc_feature: Encodes the peptide sequence at SEQ ID NO. 35238
  misc_feature (407)..(407): n is a, c, t, g, unknown, or other
aagctggagctccccgcggtggcggccgctctataactagtggatcccccgggctgcaggaattcgcacgagaccattacctagaacatcctaatcgaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggncatcagcacgctggtgtacatctccgtggcggggctcaaggtgcgcagcatcgagatggtggcgcgctccgtgctccccaggttctacgcgggcgacgtgcacccggagagccttggagggtgttcagctccttcggcaggggctacgtcgtcacggcagccccaggggtcatggtcgagcccttcggcaggccttcctagcgccgaacaaggtcgtcgggacccaacttggtaaggccggaagggacgggagggccacgggcttcatgccaaggccgggggggctcgtcgggacaaacaaaaaaaaaggcgtccgcc

SEQ ID NO: 35238 - protein, 153 aa, Zea mays
  misc_feature: Ceres CLONE 1414464-F
  misc_feature: SWISSPROT Homolog: EC 2.3.1.15 Glycerol-3-phosphate O-acyltransferase
  misc_feature (76)..(76): Xaa is any aa, unknown, or other
MVASPRFKPIEECCSEGRSEQTVAADLDGTLLISRSAFPYYLLVALEAGSVLRAALLLLSVPFVYVTYAFFSESLXISTLVYISVAGLKVRSIEMVARSVLPRFYAGDVHPESLGGCSAPSAGATSSRQPQGSWSSPSAGLPSAEQGRRDPTW

SEQ ID NO: 35239 - DNA, 738 bp, Zea mays
  misc_feature: Ceres CLONE 1414465-F
  misc_feature: Encodes the peptide sequence at SEQ ID NO. 35240
  misc_feature (694)..(694): n is a, c, t, g, unknown, or other
  misc_feature (722)..(722): n is a, c, t, g, unknown, or other
aaagctggagctccccgcggtggcggccgctctagaactagtggatcccccgggctgcaggaattcgcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcgaggttttgaaaactcctgtctcactcgatatgcttgggcgcatttttaatggttctggaaaacctattgacaatggccccccgatattacctgaagcctacttgatatttctctgggaagtctattaatcccagtgagagacctatcccngaggagatgatccaaactgggatacccnaccattgatgtgatga

SEQ ID NO: 35240 - protein, 132 aa, Zea mays
  misc_feature: Ceres CLONE 1414465-F
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLIFLWEVY

SEQ ID NO: 35241 - DNA, 721 bp, Zea mays
  misc_feature: Ceres CLONE 1414471-F
  misc_feature: Encodes the peptide sequence at SEQ ID NO. 35242
  misc_feature (415)..(415): n is a, c, t, g, unknown, or other
  misc_feature (449)..(449): n is a, c, t, g, unknown, or other
  misc_feature (514)..(514): n is a, c, t, g, unknown, or other
  misc_feature (592)..(592): n is a, c, t, g, unknown, or other
  misc_feature (593)..(593): n is a, c, t, g, unknown, or other
aaagctggagctccccgcggtggcggccgctctagaactagtggatcccccgggctgcaggaattcgcacgagaccattacctagaacatcctaatcgaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacnaggcttcgaacacgctctccatcatcgacagcgncatcggcatgaccaaagtccgacttttgtcacacctcggtaccatcgccaggtccgggaccaggnagtcatggaaacccctgctgctggcgctgatgggccaatgatgggcagttcgggggccggtttcattctgccaacccnnccccaaaagggccgtccggacccccaggcttactgtgccggcggtacggggggaatcccgggggggggggcgttccgggtacccgggacccttggggaaaaattttggagggaaaaaaaaaacccttt

SEQ ID NO: 35242 - protein, 117 aa, Zea mays
  misc_feature: Ceres CLONE 1414471-F
  misc_feature (72)..(72): Xaa is any aa, unknown, or other
  misc_feature (83)..(83): Xaa is any aa, unknown, or other
  misc_feature (105)..(105): Xaa is any aa, unknown, or other
MATETETFAFQAEINQLLSLIINTFYSNKEIFLRELISNSSDALDKIRFESLTDKSKLDAQPELFIHIVPDXASNTLSIIDSXIGMTKVRLLSHLGTIARSGTRXSWKPLLLALMGQ

SEQ ID NO: 35243 - DNA, 754 bp, Zea mays
  misc_feature: Ceres CLONE 1414473-F
  misc_feature: Encodes the peptide sequence at SEQ ID NO. 35244
  misc_feature (591)..(591): n is a, c, t, g, unknown, or other
  misc_feature (730)..(730): n is a, c, t, g, unknown, or other
aagctggagctccccgcggtggcggccgctctataactagtggatcccccgggctgcaggaattcgcacgagaccattacctagaacatcctaatcgaaaactctctcgcgcgtccgcgcccgcgcccgcggcctcgttcaatccgccagcgctcccccgccccccggtggtagcgggctctacggcagcgctcctctccggttcccctgcgctccgcgtcttcatctgtggcggccgacgctccgtcggtgtctcgtcggacggagcgagcggagctagggttccgtttcatgctcaggatcggcgagatctagggtctcgatttcagggtgattgtactggatagctgctgctgatattgcaagacaatgaaagctcatcagcagcaaggtaatgcatctggcacaggagcaaagaccaaatctttttttgataagatacaaagcctgaaagctggtgcacatatcaacaaatcatcaggcaatgtggctgcaaagcgtagaaaggtctctccttttgaatcacatacccaaagcaagatagcatcaaagactggcagtcttatggaagcgccagcaagtgatgctaangtgtctgctccgccacctaatcactctggaaagatcaaactttcactttttccattatatgaaaccattcaagagattatgcagcaagaaaaacacatccttaccttgaaattgacttggctcctccgaagaagatggncctcatttacatcatctgatacaa

SEQ ID NO: 35244 - protein, 128 aa, Zea mays
  misc_feature: Ceres CLONE 1414473-F
  misc_feature (74)..(74): Xaa is any aa, unknown, or other
  misc_feature (121)..(121): Xaa is any aa, unknown, or other
MKAHQQQGNASGTGAKTKSFFDKIQSLKAGAHINKSSGNVAAKRRKVSPFESHTQSKIASKTGSLMEAPASDAXVSAPPPNHSGKIKLSLFPLYETIQEIMQQEKHILTLKLTWLLRRRWXSFTSSDT

SEQ ID NO: 35245 - DNA, 872 bp, Zea mays
  misc_feature: Ceres CLONE 1414476-F
  misc_feature (872)..(872): n is a, c, t, g, unknown, or other
acccgcggtggcggccgctctattactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattggtagatacgtactcgggtggagcagaacaacgagagacatggcgacgacgacgcgtgttgccgccaccgccgccggcgtgctgctggccctgtcggcgttgccgaccctggcggcggccgaggacccgtacctgcccttcgagtgcaaggtgacgaacggtacccagctccctgttgggccgcgtcccacaagggcctcccctcaatccgtcggtaagagtcccccggcccccaggtatccccctgcccaccttgcataattcatttcccccacccccccatcggccttactctccaggcctttttccccctcccccacccctcttgtcaccctggaccacgtggacacggtacccaaacactcaatacaaacttggtgagtgcgcccatcgccctacccactgccgctcagcataattcgcgtggccaccgcacctcgcatatcccctctgtctgtctgtctaatactctttttcatcctccgctgttcatccacgagcaactgagcgcttatcttgttagccatcgtccattcctagccccgtttccaccctatagacatccgtatgcctcaccgcgaactcaacatctccaagctgaatgctatcaactctctatctcactcttactatcgcgcatccn

SEQ ID NO: 35246 - DNA, 801 bp, Zea mays
  misc_feature: Ceres CLONE 1414478-F
  misc_feature (690)..(690): n is a, c, t, g, unknown, or other
ggagctccccgcggtggcggccgctctataactagtggatcccccgggctgcaggaattcgcacgagaccattacctagaacatcctaatcgaaaaacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagtcgtgccgcgtgcgcgtcgtcgcgtcgcccgcgcgcaccccccgctgcccgtcgttcaccggctcggtgaagagcgcgctgacgttgacgcacatgatccttggagagggcctagtaacccccccctcgtctggaggaccgtataaaacggtctgcaccagacacccccgtctttttctgcttggaggcagcctggcccgcgccccctgccccgcgggtcctactataataccaaaactatataattaatgtcaataccaaagacaggacagtttcgctctctacctagcatgcctataacaactcccagacgctcccaatcatactggcccactctgaccttcttttcacatataacactttcccttcgccctatttcgcatccanttcatcagacacaatgatacattctctccactactcataatccatgtccatttcactcttagtaacacatcactccgtcccctcactataccacaccatcatgcctacctg

SEQ ID NO: 35247 - DNA, 730 bp, Zea mays
  misc_feature: Ceres CLONE 1414483-F
  misc_feature (357)..(357): n is a, c, t, g, unknown, or other
aagctggagctccccgcggtggcggccgctctagaactagtggatcccccgggctgcaggaattcgcacgagaccattacctagaacatcctaatcaaaagacacacacttctctcttgttctcgggttctggaaaggcaatgaagcatgttcagttaccaccacggagcacggcggaaaccaccaggaacccgccgcctgacgagtagaattgtgttctgatcttctgccgcgccataccatgcggactgtcattgcgtgagtaaagagggcgtcgtcgtctgagccacacaaccgacgttaagagtaccagcactgaaacaaggacatgaggtacagaacataaagcgaatgacngagatgcctgttcatggtactcgttcatcaacatgttcaccggactctgcatttgcactctatgcggctagctcgtagcatgaagctgtgttctacaacgttcagtattgaacaagtcactgctgagcacggatagactctactgcaacaaaggcttccgctgcatccgcatggtaatagcatccacgtctagttcaactccttcatggtcaacgagagcagaacggctgtgcatcgttacaccgtgccgttgctgctactgacgcacgtctccatcagaaactgacgtgttggccctgtggtgtactagactaacgtggatcgaatgcaccctcgattgaattgaggaccgtgtacaaagtacctctgagtt

SEQ ID NO: 35248 - DNA, 736 bp, Zea mays
  misc_feature: Ceres CLONE 1414488-F
  misc_feature: Encodes the peptide sequence at SEQ ID NO. 35249
  misc_feature (402)..(402): n is a, c, t, g, unknown, or other
  misc_feature (558)..(558): n is a, c, t, g, unknown, or other
  misc_feature (562)..(562): n is a, c, t, g, unknown, or other
  misc_feature (736)..(736): n is a, c, t, g, unknown, or other
tggagctccccgcggtggcggccgctctagaactagtggatcccccgggctgcaggaattcgcacgagaccattacctagaacatcctaatcgaaaatagggtttctcgcgcggcgctccgctccccgccctcctccgctccgcgcccgatcgcctcttcatctacctcctcaaagcttcgactgttccacacccccacccatatcaacccctttcccctttagctccttcccaccgatacgcccgccgcgtgaagcattcgttagccgagccgccgcaaccatgtcgtcgttctggggtgtggaagtgaagcccgggaagccctacactctcacccatggcgacttcgccggccgcctgcgcctcacccaggcgacgctaggggttgattgtcggcaaggnggagaaggctaccggcgtgaaagagtgtgtgctacagtgcagtgccgagaacagagatcccgttttttctttgcgtcctcatggccggagcagtcggagacatgccacctggagctagaatttggaggaggaagtcacctttctcagtgattgggncaangagcatccacctcgctggatactatagactgatgcgtgtggggaagaaaaggattgacgggggatcttggagcgattttcttcaaagtcaaaattgaggatggttttctgggaggaaggacgatgatggaaacatgggttatgggatatccaagacgtgaagatggatgattcn

SEQ ID NO: 35249 - protein, 89 aa, Zea mays
  misc_feature: Ceres CLONE 1414488-F
MSSFWGVEVKPGKPYTLTHGDFAGRLRLTQATLGVDCRQGGEGYRRERVCATVQCREQRSRFFFASSWPEQSETCHLELEFGGGSHLSQ

SEQ ID NO: 35250 - DNA, 859 bp, Zea mays
  misc_feature: Ceres CLONE 1414494-F
gtttgttttttttcaccccctcctccccttcctctagagacagtttgtgacacccccaaagctggagctccccgcggtggcggccgctctataactagtggatcccccgggctgcaggaattcgcacgagaccattacctagaacatcctaatcgaaaagtgagtcctgagtagtgactcgtctggtctcccctctctcgtccgtctggtcctcccgtccagaggcgttgtctctcactccccctttcctctgggcatcgaacccgtctccccgttctgactccgcccgcgccgccgacctcccggcagggacccagtttcatttccgcggcgcggccgcctctctccgattcaaccccaaaatgccgggaaaccggggggctctccgagggtgaattttcttggggacgggcctgaattttggttttgtttttggaaaacggcccggaaacttggggattggatccggggtgtgccgccctttttctctaaggggcgcagtttgccccttaccctcggctaaaaggggaagaattgagtgaaacaaaaaaggagcaaccacactcgccccctctttagtattgggcgggagatataacccccccatgtttggggaccaggagagcatgggggggcgcccggcaacacatgggccgaggcatttttccgagcattagagcgatattccactggtgttggatcccctggagcccacttcacaacctgggcgagcaaaaaatatcctatattcgagagcggggagaacacaacacgagcgcggccgccactcatatccgaagccaggcgcgccgaaccaaacaacataacgtgtcacgtctataacatcacgtctacgaga

SEQ ID NO: 35251 - DNA, 726 bp, Zea mays
  misc_feature: Ceres CLONE 1414496-F
aagctggagctccccgcggtggcggccgctctataactagtggatcccccgggctgcaggaattcccacgatagcattacctagaatatcctaatctaagaaactcaaactatcttctatttagaaccaaaattgatcagatcgtggtgactcagcacactctcgcttgccactctctttgccgcaatcgagcttccttcatgcgaacaacaaaccggagatactgaacaagaccttcctcattcacctctcgtccgagcgttctggctcaatattggtgagggagcatcagatagctatcctacttttgacactacgggtccattcaataatatacgggctcatgccactgttgagggttcattgttgtgtcaacgtacttcttgggtcgaacgatatgcatgatgaccttcgagatgatcttgctgaccatagccctattcctgccgataagcagagagattgttgtaatgcttaggcccaccattgtcatatgctacataactctcatgcatgtgaccttgccaacgtgcatggcagtagggcaaacactcgcatgcaccatgagaactgcctctcgcagtatgctaatctgttccaagacattgtacctctaccgatctatgccgaccacgatctgtggctgtgacacgataatccctgtcccgaaaaaggagtggacctcgttcgagtgctgttcctactaccccaaaccgagtgctggaa

SEQ ID NO: 35252 - DNA, 739 bp, Zea mays
  misc_feature: Ceres CLONE 1414497-F
  misc_feature: Encodes the peptide sequence at SEQ ID NO. 35253
  misc_feature (394)..(394): n is a, c, t, g, unknown, or other
  misc_feature (514)..(514): n is a, c, t, g, unknown, or other
  misc_feature (515)..(515): n is a, c, t, g, unknown, or other
  misc_feature (567)..(567): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaacgctcgtggccaccgatttcactggcttcatttcgaatcataaatttcatctactggagtttgctttgcttgctcctggaatcttcggaaccgaaggccaccgcgccaaccgcccaattaccgaaccaaaccctaccggtcgcggctcctccatagtccatactctcgcgcgcctaaaccctagccatcctcctcgccgccggcgaccgccgccatgagccgctacgacggccgcgctgcggacgcgggctcctaccgcgaccgccgcagcgagggggcgttcggaggcggntcgagggcgttctcggcgccgagcaaggcggacgcttccgcggcggcctcggaagctggatgggctgccgcgcttcgagagaacttctacgtgaggtcacccgcggtggccgcatgacgnnaggaaagaggtggaggcataccgccgcccgccgggagaccaccgtcgacggnccgcgacgtgcccaagccgggtgcttgaggtcccgtgatgtgggctccccagaatatgtgttgcaagagacacaaaaagctgggttttgtgggacctacccctatccaatcgcaggtggggcgaatgncattgagagcccgggacctaattggaatggcaaagacagggatc

SEQ ID NO: 35253 - protein, 64 aa, Zea mays
  misc_feature: Ceres CLONE 1414497-F
MSRYDGRAADAGSYRDRRSEGAFGGGSRAFSAPSKADASAAASEAGWAAALRENFYVRSPAVAA

SEQ ID NO: 35254 - DNA, 735 bp, Zea mays
  misc_feature: Ceres CLONE 1414503-F
  misc_feature: Encodes the peptide sequence at SEQ ID NO. 35255
  misc_feature (392)..(392): n is a, c, t, g, unknown, or other
  misc_feature (408)..(408): n is a, c, t, g, unknown, or other
  misc_feature (409)..(409): n is a, c, t, g, unknown, or other
  misc_feature (457)..(457): n is a, c, t, g, unknown, or other
  misc_feature (523)..(523): n is a, c, t, g, unknown, or other
caaagctggagctccccgcggtggcggccgctctagaactagtggatcccccgggctgcaggaattcgcacgagaccattacctagaacatcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtcccaactcgaagcttcagactcgtgctgtcgtgctgtgcacgacccctcccctagcatcccnagctccctactgagannacaggagatgggaagagacggggaacagactaggcgccggagccgcangagatcccgcgacgcctccccctctcgtcggattcggattctttcgacttcccatcttctccgagnagtaaccctggacgacggagccgcaacagtaagcgggaatatatattcttatggaaccgcccaggcgaaaaaaaggaccggggtcgcggaaatcccccggacaggaccgcgggggggggaaaaaaagggcccagaaaaaaagggcccccggggggaattgttcccaacccctcccactccaatctcaggagggaaaaagggcggaaaagccc

SEQ ID NO: 35255 - protein, 106 aa, Zea mays
  misc_feature: Ceres CLONE 1414503-F
  misc_feature (14)..(14): Xaa is any aa, unknown, or other
  misc_feature (36)..(36): Xaa is any aa, unknown, or other
MGRDGEQTRRRSRXRSRDASPSRRIRILSTSHLLRXVTLDDGAATVSGNIYSYGTAQAKKRTGVAEIPRTGPRGGEKKGPEKKGPRGELFPTPPTPISGGKKGGKA

SEQ ID NO: 35256 - DNA, 788 bp, Zea mays
  misc_feature: Ceres CLONE 1414507-F
  misc_feature: Encodes the peptide sequence at SEQ ID NO. 35257
  misc_feature (788)..(788): n is a, c, t, g, unknown, or other
cagagctggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccagacaggcaccagccgtcggcggactatcggcagcggaggggagcaccggcacctggtcgcgctcgccgtcgccgcgggcgtcgccatgttcaccacacggtcctcgggtccagcagcagtaacggaaggtgatagaacgggaacctgcttgaacaaaagcccgggcccgctggcggggggcggaacaatgcatggaggaacttctttcaactgccctccctcggtttgctccgccgcgttaacgaattaaatggggctggcgggggcggcccccagcgggaggccggcgcccgaccgcatgacttcgcagagtttgctggaggccgggcccctggcccaaactggactcccgggatttttccccagagggagttttaagggccacaaccccccggcn

SEQ ID NO: 35257 - protein, 91 aa, Zea mays
  misc_feature: Ceres CLONE 1414507-F
MVEAAAGRQTGTSRRRTIGSGGEHRHLVALAVAAGVAMFTTRSSGPAAVTEGDRTGTCLNKSPGPLAGGGTMHGGTSFNCPPSVCSAALTN

SEQ ID NO: 35258 - DNA, 639 bp, Zea mays
  misc_feature: Ceres CLONE 1414508-F
  misc_feature: Encodes the peptide sequence at SEQ ID NO. 35259
aaagctggagctccccgcggtggcggccgctctagaactagtggatcccccgggctgcaggaattcgcacgagaccattacctagaacatcctaatcgaaaaatgctctgatccccatttagagctgatcgtcgcgtcgaggtactctactcatgcacccagccactacgtactatttgctcatcaagctaccaaggatttcttggttacgctagctcgccggtttcttggttgttactagcacccggcggcgtctgttcgtccacagctagccaatctctctctccgggggacgagacgatggacatcatcaacggggccgtgctccctcgctgccacgccgcccccgtcacgggcgccgcggcgccctcgtcgccgacgcgagagtgagcggacacctcagcttctccggcgcgtgcgctgcaaaggaggcgaaagcgcagtgccgggttgctgcatgcgaccacccccccaacccgggttggcaacccccaagttcctcccccccaccctggggaacgggaaacggaaatggaaggacccttgggtgggggggccggtttcctttaccccacgggggggttccccctccccaaaggaggaaaagggcccccccccccccccggaaattttcaaaac

SEQ ID NO: 35259 - protein, 36 aa, Zea mays
  misc_feature: Ceres CLONE 1414508-F
MEGPLGGGAGFLYPTGGFPLPKGGKGPPPPPGNFQN

SEQ ID NO: 35260 - DNA, 726 bp, Zea mays
  misc_feature: Ceres CLONE 1414509-F
  misc_feature: Encodes the peptide sequence at SEQ ID NO. 35261
aaagctggagctccccgcggtggcggccgctctatcactagtggatcccccgggctgcaggaattcgcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcgaggttttgaaaactcctgtctcactcgatatgcttgggcgcatttttaatggttctggaaaacctattgacaatggccccccgatattacctgaagcctacttggatatctctgggagttctattatccccagtgagagaacctattcagaggagatgatccaaactgggatatccaccatg

SEQ ID NO: 35261 - protein, 151 aa, Zea mays
  misc_feature: Ceres CLONE 1414509-F
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSIIPSERTYSEEMIQTGISTM

SEQ ID NO: 35262 - DNA, 840 bp, Zea mays
  misc_feature: Ceres CLONE 1414510-F
  misc_feature: Encodes the peptide sequence at SEQ ID NO. 35263
ccccccctacccccccacctgtcggctctttctttccttctccaaagctggagctccaccgcggtggcggccgctctagaactagtggatcccccgggctgcaggaattcgcacgagaccattacctagaacatcctaatcaaaactctcctatcttctctctctccatcgctccctcctccgcgccgcgttggcaccgaaccctcctgtcatggcaaggccgccgaaggaggcgattgataccttcatcagcatcacgggggcggacgaggccgtcgccgtacgcaaactcgaggaacatggtggtgatcttaatccgagcaataaattcacatttcaatgacggaaacagcactattgaacggaatcactccaaaccgccatgcctggctaatccgtgatgacattgatggcacctggattgcacccacctgaataataacatattcaaaaggaatcttttggtggccaaaagaagtttcccgggcccccttttcggccctaaagggactgccaattctccccggaccccattttctttttgaaccaaacatcgggcccccccactcggagggcgcgcccttcccgggcaccccgattaagtttcccacctcctcaacacagagcgggggacggggcacccccctaccgccaaagctctacaggtccgcgggatccctccccaaaaacgtctcccacacccgcccaccacgaggtcgccccttgcgcaaatagcgcgcctcctctcaaaccgggggccccccccccaatcctccccgcccaacatcacctcacacgttttagcacctagtactcgccactgcgatagaacgcgcgagc

SEQ ID NO: 35263 - protein, 43 aa, Zea mays
  misc_feature: Ceres CLONE 1414510-F
MARPPKEAIDTFISITGADEAVAVRKLEEHGGDLNPSNKFTFQ

SEQ ID NO: 35264 - DNA, 714 bp, Zea mays
  misc_feature: Ceres CLONE 1414513-F
aaagctggagctccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaatcttggggagttctgttcatgtgcatttgagcttacgcatctatgatacgcgccttagggattgtgatctgtgattaggggttgtgaaattgagatgccattttagggattgtggaagtgtgaactgtggcttactgaaatcgagatgccatttgagcaagttttcaactattttgttggaattggcgaggttatgagaccttttccaatactttatatccgaattgttggaaaatata

SEQ ID NO: 35265 - DNA, 641 bp, Zea mays
  misc_feature: Ceres CLONE 1414514-F
  misc_feature (234)..(234): n is a, c, t, g, unknown, or other
atagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctcccctttaccntccggctatcgccctgaaggataaggtggggccttgaagggggagccttagggggggaagcaaaaagggatagggaaaggggaaaagatgaaaaccaatccattttttttttgggccccgccttttccccccccggggttttaaagtccccccccgttataaaaaaaacccccaaagagaaaaatttttgggggtttttttcccgggttttttaaaacaccacctctccccccccctttttgggccccaacaaaaaagaggggggggaaaacccccctccaaaaaaacctcccccccaaaaaaaaaagggggaaaaaaaaaaaacgtttttggccgaaaaaaatatttggggggggggaaaaaaaaaatattcttcggggggcggggggttaatataaaaaaaaaaa

SEQ ID NO: 35266 - DNA, 723 bp, Zea mays
  misc_feature: Ceres CLONE 1414520-F
  misc_feature: Encodes the peptide sequence at SEQ ID NO. 35267
aaagctggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcggctgctggaggtggcgggccggcgcggcctggcgctgcgcgccgccgcgttcgtggccaccgcgggcgtgccgcgcgccgaggtggaggcagtgtcgcgcgccgtgctgcccaagttcatggccgacgacgtcgtccccgccgcgtgggcggacttcgggag

SEQ ID NO: 35267 - protein, 117 aa, Zea mays
  misc_feature: Ceres CLONE 1414520-F
  misc_feature: SWISSPROT Homolog: EC 2.3.1.15 Glycerol-3-phosphate O-acyltransferase
MQTTTSSAAASPRPRARAPQSVVAELEGALLRSADTFPYFMLVAFEASGLPRFALLLALWPLLRLLEVAGRRGLALRAAAFVATAGVPRAEVEAVSRAVLPKFMADDVVPAAWADFG

SEQ ID NO: 35268 - DNA, 692 bp, Zea mays
  misc_feature: Ceres CLONE 1414523-F
aaagctggagctccccgcggtggcggccgctctataactagtggatcccccgggctgcaggaattcgcacgagaccattacctagaacatcctaatcgaaaactcctccattcctctccctctctctctcgtcggtgggaccgggggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgagcccaattcggagcctggctgactccgcacgttttccccacttttccctccctcggacgaggaccgtccgcccaccaccggatccggaagcgaccctccctcgtgctcgtcgaagatcgaccggccgccgagtcgtcaggaaagatgcccggcctcaagaagccgctgggtctcggaaacccgcccaagttgaggattaaacaaatccggggggacccggcccctgggggcccggagggcaccgggcggagaaagaacacccccggggcgggcaaaaaaaggaaaaacctcccgcgaagaggggagccccccaaaggggtttcctcttgggggaggaaccccc

SEQ ID NO: 35269 - DNA, 675 bp, Zea mays
  misc_feature: Ceres CLONE 1414524-F
  misc_feature: Encodes the peptide sequence at SEQ ID NO. 35270
caagctggagctccccgcggtggcggccgctctagaactagtggatcccccgggctgcaggaattcgcacgagaccattacctagaacatcctaatcgaaaaacagcgatgtgggcctcacatgctatcagcggacctccacacacgcacacagcacagacaggaacgcggaagaaaaagttcattcatatatgcaagctcgcacgtgggaaatctcccccatcaatgcacgcaacgcactcaaacgatagaaggatggaagatgagctaatccactacaacacctataggcaggtgtatttaggctgcgctgcaccaactgccgtgcatgcagtgcatggcgcaggaaggctctgaggccgccaaccacagctcaccgccgacacagccgacgccgacatgctcctcctggtgccgcgacatgcgccacccggctgcctactgcgagtggccaccgtcccccgagaggaggtggccgccctctatatcgatggagcctgtagcgactcaccatcagcaacatgacggcggacggacaactaaaccatcctacgaacgcacgatctccaacgccaccagagtgtccatcacacaccactccggagtcggactccatccaggactcccctcagagaaatgaagccgccgccggtggccgcaacaactcacaaagcc

SEQ ID NO: 35270 - protein, 103 aa, Zea mays
  misc_feature: Ceres CLONE 1414524-F
MQCMAQEGSEAANHSSPPTQPTPTCSSWCRDMRHPAAYCEWPPSPERRWPPSISMEPVATHHQQHDGGRTTKPSYERTISNATRVSITHHSGVGLHPGLPSEK

SEQ ID NO: 35271 - DNA, 688 bp, Zea mays
  misc_feature: Ceres CLONE 1414525-F
  misc_feature (301)..(301): n is a, c, t, g, unknown, or other
aaagctggagctccccgcggtggcggccgctctagaactagtggatcccccgggctgcaggaattcgcacgagaccattacctagaacatcctaatcgaaaattccacctctcaatctcaccccacgcctgccccgagctccaaccctaaaggaacacacccctgcttgcggcggcggggagcggtcttgggcgtccgccttttgctgtggcccagccgtgacagatccgggccccgcgccgttaggtcggtgtttcttcggcgacggtgtagccgctggatgttagtctggcggatcggngcccgttgttcgcgtgattcgagctaggcggtgttgagttgtaacatttgtgtcacatgaatgaactcagagcatctcagtgttaaaactgtgagcatatcaattcccctcctttaagcaatatgggagctaattgctgcattgctgcaaaggagaggacacaccatgcattactccattaaagtatcagcgtacaggaatgtgagacattccccatcatgaagctttcggtgggacattccccccccctatgaaaacctaagggaaatccctactctggtctccacccaagagagggaagaattccacccggaaaaaaaaggggtcctttggccccaatgaagggttttctaagggaaaaaccctgggaaacacccccttccaagg

SEQ ID NO: 35272 - DNA, 763 bp, Zea mays
  misc_feature: Ceres CLONE 1414528-F
aaagctggagctccccgcggtggcggccgctctagaactagtggatcccccgggctgcaggaattcgcacgagaccattacctagaacatcctaatcgaaaaacaaatgtcgcctcccctgataacctgacatacaaccgagaatccttggaacttcgatttagtgagcggctcctcacgtatcacataaccaagaaccgacgcctcacgtgaactaccgggaatatgtcccctgaatcactgcaaagcttttcaagcttctccgtacttattttcatggagaagtttcaaaaaccccagtgaagctctcgcatcaaatatctaaaagaaccctaaccatgctcgaccttcatttttttttttgccatgaacaactgctagtcacgcacatcacaaggatttcctaattctccacactctacaaccattattttcacaggttcaacaactctcaacttcccctcaacccaacccagaagaagtgaatacaagcgtaaccctcacagcttccagaacttttcaacgtcatgcaaattcctaaaccaggaattctctttaaagctgttgacgcgtcccgaccctccttgtctcctgccaaaaagcccccctgaaccacatgatatttacgtccccacattgatgttgatacccaatgtttccccgactggggcgtaatttgccaagtaaaccctgggagcaaaaccgttgttttggcgaacccttggtttcccggtcgcggccaaccagcccccttggcacctgg

SEQ ID NO: 35273 - DNA, 775 bp, Zea mays
  misc_feature: Ceres CLONE 1414532-F
  misc_feature: Encodes the peptide sequence at SEQ ID NO. 35274
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (45)..(45): n is a, c, t, g, unknown, or other
  misc_feature (46)..(46): n is a, c, t, g, unknown, or other
gcccccccccnntnnnannccctaccccnnntagcgcccggcccnntttcaaagctggagctccccgcggtggcggccgctcttcaatagtggatcccccgggctgcaggtattcgcacgagaccattacctagaacacctaatcgaaaacattactgacaagcgccagagcagagagggagagatagaacacacaaggggagaggggcggcgaagggaaggcgaagggaggcgcactcgtcccgcctggtgctctggtatcgtctccccccggcagggaaggagtataaggaaggagagtacgtaggaggaggaggggagaatgcgtgtcggcggcgggcgggacgacgacgacgaggtgtcccggaagctcaagagcatggacgtggacaagctggagaacggcggcagggaggagagtccgcggcccgccgtccagtaccacggctggaaggtcttgcccctcatcatcgggaacgaaacgatcgagaagctggggacgctaggcacgtccgcgaacctgctggggtacttgacgcacgggttcctcatgctggatcgcgggacccgccgccgccaactcaacggggctacacggtgccaaccgggctagcggcccccatcatccgggggatttccctctccccacgtccatccccccggaccgataatcctacgtggttcggccatacggccctcccggtcggccctccactacactcggaccttgcgttccgtggccctgaacgaaacagaccgggctccgtgtctgaca

SEQ ID NO: 35274 - protein, 96 aa, Zea mays
  misc_feature: Ceres CLONE 1414532-F
MRVGGGRDDDDEVSRKLKSMDVDKLENGGREESPRPAVQYHGWKVLPLIIGNETIEKLGTLGTSANLLGYLTHGFLMLDRGTRRRQLNGATRCQPG

SEQ ID NO: 35275 - DNA, 726 bp, Zea mays
  misc_feature: Ceres CLONE 1414538-F
  misc_feature: Encodes the peptide sequence at SEQ ID NO. 35276
  misc_feature (575)..(575): n is a, c, t, g, unknown, or other
  misc_feature (584)..(584): n is a, c, t, g, unknown, or other
  misc_feature (585)..(585): n is a, c, t, g, unknown, or other
  misc_feature (602)..(602): n is a, c, t, g, unknown, or other
  misc_feature (647)..(647): n is a, c, t, g, unknown, or other
  misc_feature (685)..(685): n is a, c, t, g, unknown, or other
  misc_feature (726)..(726): n is a, c, t, g, unknown, or other
aagctggagctccccgcggtggcggccgctctagaactagtggatcccccgggctgcaggaattcgcacgagaccattacctagaacatcctaatcgaaaacaaaatagcgagccgaagggggccacgaccacgagtcctccacctccctctccgccgcgtcgcacgcgcttgacgcgcgccgagagccgaatcggagccacgaggcagccgccccgggcggatcgatcctagggccagggcatgggcggaggggacgccgaccccggcggcgagcccgcggacgcgcaggccacgctccacatccggtgcaccaacggctccaagttcaccgtgcggaccgacctgggcgccaccgtcggggcgtttaaggcgatcgtcgcccacagctgcgacgtgccggcgccgcagcagcggctgatctacaagggccggatcttgaaggacgagcaaaccctagccagctacggtgtggagacagacccatacatccacatggtacgtggtgctgtgctatcaccaacatctactgcacctgcagccaaccaagaaactaccactgctgctccctgcagntccccggcnnacagatgggtggcttgntgcaaagtctgggtactacaggcgctgctgctaacagtgaggggntgtttggatctgccccccctggattagacaaatgcagncacagctagctggaaaatccgacttgatgagggaaatgatn

SEQ ID NO: 35276 - protein, 143 aa, Zea mays
  misc_feature: Ceres CLONE 1414538-F
  misc_feature (22)..(90): Pfam Name: ubiquitin Pfam Description: Ubiquitin family
  misc_feature (111)..(111): Xaa is any aa, unknown, or other
  misc_feature (115)..(115): Xaa is any aa, unknown, or other
  misc_feature (120)..(120): Xaa is any aa, unknown, or other
MGGGDADPGGEPADAQATLHIRCTNGSKFTVRTDLGATVGAFKAIVAHSCDVPAPQQRLIYKGRILKDEQTLASYGVETDPYIHMVRGAVLSPTSTAPAANQETTTAAPCXSPAXRWVAXCKVWVLQALLLTVRGCLDLPPLD

SEQ ID NO: 35277 - DNA, 742 bp, Zea mays
  misc_feature: Ceres CLONE 1414539-F
  misc_feature: Encodes the peptide sequence at SEQ ID NO. 35278
  misc_feature (582)..(582): n is a, c, t, g, unknown, or other
  misc_feature (689)..(689): n is a, c, t, g, unknown, or other
  misc_feature (742)..(742): n is a, c, t, g, unknown, or other
ggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagacgggcgtcgtggccaccatcaccggccccgccgcgggccccgtgttcgcgctccgcgccgacatggacgcgctccccatccaggaaatggtagaatgggagttcaagagcaaggaagacgggaagatgcatgcgtgcggncatgacgcccacgtggcgatgcttcttggagcagctaggttgcttcagtctcggagggacgatttaagggtactgatagtttttttggctgggcttttttgcagagnatattcagtaatccgttctactacgtacagttgtgaagcttaattgggttgan

SEQ ID NO: 35278 - protein, 161 aa, Zea mays
  misc_feature: Ceres CLONE 1414539-F
  misc_feature: SWISSPROT Homolog: EC 3.5.1.14 Aminoacylase
  misc_feature (148)..(148): Xaa is any aa, unknown, or other
MAAAPALARELLDAAREPEFAEWQRGVRRRIHQHPELAFQEHRTSALVRAELDAIGVPYAWPVAQTGVVATITGPAAGPVFALRADMDALPIQEMVEWEFKSKEDGKMHACGHDAHVAMLLGAARLLQSRRDDLRVLIVFLAGLFCRXYSVIRSTTYSCEA

SEQ ID NO: 35279 - DNA, 680 bp, Zea mays
  misc_feature: Ceres CLONE 1414544-F
  misc_feature: Encodes the peptide sequence at SEQ ID NO. 35280
  misc_feature (680)..(680): n is a, c, t, g, unknown, or other
aaagctggagctccccgcggtggcggccgctctataactagtggatcccccgggctgcaggaattcgcacgagaccattacctagaacatcctaatcgaaaacgtatatgaatcttctcagacagaattccagggaggggatgttcagaaggtgcttatttcgttgttgaaaatattgtgccaacactatggaaagcttcgttcatcctttgggtctgacccgtcacaagagggtatagatggcccagagatggcagtgacgaaacttttctcatcttgtaagagcagtgctaatatgaaagggtatggagctgttgtccattgcatgagaaatcttccctcagaaagccagattcagactactgcccaggaggttcaaagtctcttggtttctggtagaaggaaagaggcccttcaccaggcacaagaaggtcacctttggggccctgcactgatccttgctttacaacttggtgataagttttatgcggatactgtgaagaaaatggcccactgccattttgtttctggatcacccttgaggacactgtgccttcttattgctggacaacctgcagatgttttcagttttgagaatcctgttaacagtggtttgtcttctccccaacagcctgtagaggctgctcctaaaggtatgctggatgactggcaagagaatn

SEQ ID NO: 35280 - protein, 143 aa, Zea mays
  misc_feature: Ceres CLONE 1414544-F
MAVTKLFSSCKSSANMKGYGAVVHCMRNLPSESQIQTTAQEVQSLLVSGRRKEALHQAQEGHLWGPALILALQLGDKFYADTVKKMAHCHFVSGSPLRTLCLLIAGQPADVFSFENPVNSGLSSPQQPVEAAPKGMLDDWQEN

SEQ ID NO: 35281 - DNA, 665 bp, Zea mays
  misc_feature: Ceres CLONE 1414549-F
  misc_feature: Encodes the peptide sequence at SEQ ID NO. 35282
  misc_feature (425)..(425): n is a, c, t, g, unknown, or other
aaagctggagctccccgcggtggcggccgctctagaactagtggatcccccgggctgcaggaattcgcacgagaccattacctagaacatcctaatcgaaaagagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctggcgtaggagattgtattccgtctgattaatcggcggagagcaagcgggtgttgcggctgcgcgagcatggcggncgagggagctgcggagggcagcggaaccaggaggcacatggatctaaacctgtatctcggcctccctccattgccgcggcctcccagtctggttggaccccgacgttgatggccaacttggaccgttgctgcgccagatcctcaataactgggggacctggaggaatcttgggccccggggggggggagcctatttctccgcgaaagggcttttcccccccgggaggaaaatccatgggg

SEQ ID NO: 35282 - protein, 38 aa, Zea mays
  misc_feature: Ceres CLONE 1414549-F
  misc_feature (3)..(3): Xaa is any aa, unknown, or other
MAXEGAAEGSGTRRHMDLNLYLGLPPLPRPPSLVGPRR

SEQ ID NO: 35283 - DNA, 735 bp, Zea mays
  misc_feature: Ceres CLONE 1414552-F
  misc_feature: Encodes the peptide sequence at SEQ ID NO. 35284
  misc_feature (472)..(472): n is a, c, t, g, unknown, or other
  misc_feature (536)..(536): n is a, c, t, g, unknown, or other
  misc_feature (543)..(543): n is a, c, t, g, unknown, or other
  misc_feature (557)..(557): n is a, c, t, g, unknown, or other
  misc_feature (564)..(564): n is a, c, t, g, unknown, or other
  misc_feature (594)..(594): n is a, c, t, g, unknown, or other
  misc_feature (598)..(598): n is a, c, t, g, unknown, or other
  misc_feature (647)..(647): n is a, c, t, g, unknown, or other
ccaagctggagctccccgcggtggcggccgctctagaactagtggatcccccgggctgcaggaattcgcacgagaccattacctagaacatcctaatcgaaaagccaagctttcctcaaaaactcgaaaaaggaacggagaaggcgtcctcgacgactgcccatggccgccgcccggacctagccagggattgttgtctcctgagtcccgacctaccaaggcggaaagggagagggggcgctgtggcgtcaggaaataactggaagccgagggctgagggcgagcgcagagtcgggtggttatcgctttctttttcgttttctttttccggaggggagagtattagggatgccggttgctaggccggagccgcaggagccccgggtgatcgcccatgtcgacatggactgcttctatgttcaagtcgagcagcggaggaacccggcgctcaggggacagccgaccgccgtgntgcagtacaacggctggaaaggcggcggcttgattgccgtcagctacgaggctcgtggatttgntgtgaangagtccatgcgcgnagatgangccaagagtatggcctggaattaaatctgntcangtcccagtggcgcgtggcaaggctgaccttaatccttacaaaatgctgntgctgaagttgttgcatcccttgcaggcaaggggaatggcaacggcatccatcgacgaagttatcttgacctactgatgcagcaaaga

SEQ ID NO: 35284 - protein, 79 aa, Zea mays
  misc_feature: Ceres CLONE 1414552-F
  misc_feature: SWISSPROT Homolog: EC 2.7.7.7 DNA-directed DNA polymerase
  misc_feature (42)..(42): Xaa is any aa, unknown, or other
  misc_feature (63)..(63): Xaa is any aa, unknown, or other
  misc_feature (65)..(65): Xaa is any aa, unknown, or other
  misc_feature (70)..(70): Xaa is any aa, unknown, or other
  misc_feature (72)..(72): Xaa is any aa, unknown, or other
MPVARPEPQEPRVIAHVDMDCFYVQVEQRRNPALRGQPTAVXQYNGWKGGGLIAVSYEARGFXVXESMRXDXAKSMAWN

SEQ ID NO: 35285 - DNA, 675 bp, Zea mays
  misc_feature: Ceres CLONE 1414554-F
  misc_feature: Encodes the peptide sequence at SEQ ID NO. 35286
agagctggagctccccgcggtggcggccgctctataactagtggatcccccgggctgcaggaattcgcacgagaccattacctagaacatcctaatcgaaaacatagagatagagatagacagctagcttcatcagtaggatgggcagcgacgaggaagcggcgctgctggtgccggcggtggaggagggttgccccgggtgcgtgatggagcggcggaaggcgagcagcaacggcaggatcccctacagggagctgttcttcgtcgccgccacctccctcgcctcagctttaccgatcacgtgcctcttccccttcttgtatttcatggtaagggacttccgcgtcgctgaaacagaggaagacatcggattctatgctggttttcttgctgcgtcgtacatggtgggcagaggcttctcttccatcttctggggcgtcatcgcagaccgcgttggacggaaagctgtcatcacgttttcgatactggtcgtggtcgtattcagcgcgctgtttggtctgaccacgacgtactgaatggcaatcgccaccaggttcgggtgggggttttcaagggccggttcccccaaaaaggcaactgggttaaatttgccaaaaccaaaccaggggttggactttctcttgggaaaccggagggcctcggggcccatttggg

SEQ ID NO: 35286 - protein, 131 aa, Zea mays
  misc_feature: Ceres CLONE 1414554-F
MGSDEEAALLVPAVEEGCPGCVMERRKASSNGRIPYRELFFVAATSLASALPITCLFPFLYFMVRDFRVAETEEDIGFYAGFLAASYMVGRGFSSIFWGVIADRVGRKAVITFSILVVVVFSALFGLTTTY

SEQ ID NO: 35287 - DNA, 668 bp, Zea mays
  misc_feature: Ceres CLONE 1414557-F
  misc_feature: Encodes the peptide sequence at SEQ ID NO. 35288
tccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggcccccgtggaagggcgaagcaggcgctctactcgagggacctcgctcgcaacctgcgcttcgcctccaacttcgacctcttcaaggctgctgcggccgactggcgcgacacgctcttcctgcgaggtggctccgaacccgccgccgcggggaggagctgcc

SEQ ID NO: 35288 - protein, 177 aa, Zea mays
  misc_feature: Ceres CLONE 1414557-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPRGRAKQALYSRDLARNLRFASNFDLFKAAAADWRDTLFLRGGSEPAAAGRSC

SEQ ID NO: 35289 - DNA, 588 bp, Zea mays
  misc_feature: Ceres CLONE 1414559-F
  misc_feature: Translation starting site: 163
  misc_feature (232)..(232): n is a, c, t, g, unknown, or other
  misc_feature (238)..(238): n is a, c, t, g, unknown, or other
  misc_feature (313)..(313): n is a, c, t, g, unknown, or other
  misc_feature (314)..(314): n is a, c, t, g, unknown, or other
  misc_feature (332)..(332): n is a, c, t, g, unknown, or other
aaagctggagctccccgcggtggcggccgctctagaactagtggatcccccgggctgcaggaattcgcacgaaccattacctagaacatcctaatcgaaaaaatcagtgctcgctagcccaccacgccctgaacctagcccggacaccagccagaacaggccatgtccatgggctccccggtgcagctcaggcggctgaagcctctgtaccagttcgtgggtgaacaacatncctggncatcgtgggccgtgcccgctcgccacccgcgtctgctcaggcgtcgcgctcgggccgagagatctggcgctccgnncgggcacctgttcctggncgggtcctgcctgccggggccacgtgctgtaactgatgctcgggccgcccacgtggaccctggggaaatacgtggggttccgaaccacccccaattgccggggccccgtttggggaaatttcttggaaaaatccccccggggggggggcgggtttttacaaaaaagagcaagggccccctttttttataaaaccccccctcttttgtaaaaaagcgcccgcgtccttccctgaaaaaaaaaaaacacccccccccc

SEQ ID NO: 35290 - DNA, 772 bp, Zea mays
  misc_feature: Ceres CLONE 1414561-F
  misc_feature: Encodes the peptide sequence at SEQ ID NO. 35291
  misc_feature (342)..(342): n is a, c, t, g, unknown, or other
  misc_feature (470)..(470): n is a, c, t, g, unknown, or other
aaagctggagctccccgcggtggcggccgctctagaactagtggatcccccgggctgcaggaattcgcacgagaccattacctagaacatcctaatcgaaaaacaagacgagatctacccgctgccccctcgcattcccctcccccgcgtcgtcatctccccaaatccccccaaaccctaccgccgatccggccccagatcgccatggccgcgcccaacagcaatgacgccgccagcgccagcggcaccggcccggctggcgaggaggacatctccatcgaggcgttggcgcggcgcgtgcaagagcacatgaccctcaactcgaaccccgccgctcgccgncacaagttctgggagacacagccccgtcggcagttccgcgacgccgccgacgcatcgctaccgaacggccccatcgaggcgcccacgccacttctccgaaggtgggggcgacccctacccactggccngcggcctttgaagggctccacctggaacctcgattgaagaaggggttccctggcgaactttaaattggtggttcgccaaaaattaattgaaaggagaaaaaaaaattgttccgtttaaaatattccccgggctttcccccggggggggtataagccccgcggccttttttcggggcggaaaaattgggggttcccccaaagaaacaaaaaaatttccccttttttttggggggccccccccccatccgggtttgggagaaaaatccccaagaggggaaaaaaatttttttttgggcaaaaaa

SEQ ID NO: 35291 - protein, 100 aa, Zea mays
  misc_feature: Ceres CLONE 1414561-F
  misc_feature: SWISSPROT Homolog: EC 2.3.1.97 Glycylpeptide N-tetradecanoyltransferase
  misc_feature (89)..(89): Xaa is any aa, unknown, or other
MAAPNSNDAASASGTGPAGEEDISIEALARRVQEHMTLNSNPAARRHKFWETQPRRQFRDAADASLPNGPIEAPTPLLRRWGRPLPTGXRPLKGSTWNLD

SEQ ID NO: 35292 - DNA, 650 bp, Zea mays
  misc_feature: Ceres CLONE 1414563-R
cgattgggtaccgggccccccctcgaggtcgacggtatcgataagcttttttttttttttttttggtctcaagaggaaatcatttaacatcgttatttttgcacatgagatgacaaccaatatattgaccacatcgatcatgcaatagctagtacgtaggtacacttttggatgaaattgaacagagaaaagagaaattgaaagctaagaaacaggacttctaccattaaaattaatagcacatacaaacactaaagaaaaaaaatatgatatgacgacagcctcctgcgttgcattcccatgaaccccatccatccgcctggcggcacgtgtccatccagccatccgtcgaccaaccaacaggtaggatgaaccgatcaatccatccatacagtatatgatgatcacgcaccttccccgtggactaattaagtaataactgtaatttataccgcagagcgcgggaccgaattaaccccgcacaacacgcacgttgcagcaacttacccacccagccagagcccagtgaaagagtaacttgtactaataacttctctctctctccctttttttttactttccgtcatcactcgtcacgcggatgtcaccgtctccgtcgtggcccgctcgacgaaggctgcccggagcgg

SEQ ID NO: 35293 - DNA, 684 bp, Zea mays
  misc_feature: Ceres CLONE 1414563-F
  misc_feature: Translation starting site: 287
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (55)..(55): n is a, c, t, g, unknown, or other
tttatttaaannctccnnttattttgatttactcaacttnnnnngggggtttggntcagagctggactccaccgcggtggcggccgctctataatagtggatcccccgggctgcaggaattcgcacgagaccattacctagaacatcctaatcgaaaaaccctcccccaccgccattgatcagcagcagtactaaagccacgcctgacagacagctggttcatttctggttgctgccttgctggtggtagccctcggcgcaggcagccaagaacagagagagcgagatgaatgggaacgacgtgctgctagtggtgctggcggtggcgctggctgccatgtggaggagtcggtgctccaagaccggaggtgtcaacggcctcccgccggggtctccgatctggtcggtggcgaggaacctgttccaggtgatcctgcagcgacgggccttcatgtacgtggtgcgcgacctccgggagaagacgggcccatcttcaccatgcggatggggcagccaccctcatcgtgggcacctcgggggagctcatccactacgggctggcgaagcagggccccatgatcacgaggctgcccgaggacagacccacccgcctcctcttcagcgtcggtaagagcaccgtcaactcggaagccctacggccccctgaggagtgctctgtcccgc

SEQ ID NO: 35294 - DNA, 682 bp, Zea mays
  misc_feature: Ceres CLONE 1414564-F
  misc_feature: Encodes the peptide sequence at SEQ ID NO. 35295
aaagctggagctccccgcggtggcggccgctctagaactagtggatcccccgggctgcaggaattcgcacgagaccattacctagaacatcctactccaaaaagcacccggcttcacactacttctgtgttcgtgcccactggtctctcggagggcaaacaaaagcgccgctgccgccggcaatgttccaccgtctcctcccgcaccgtcgctacatctccacctcgcccgcctccaactccaaaccgaccctctactctgacggaaccatcccattctctatcctctcgtggggtcgcgcagtttccgcacagctcggtggagataaggatgagcgacgcctctacccatcccacgtcgcccacctacttctccccaaatcagacccacgccttgctcccacccccggacgccttccctctgcagaggatacgccaggagcggaggtagggatctcttgtggcatcttacactcctcgctcctcgtcgaaggaggtctctgggagtgatgcaagttcaactgaggccgcctcgtcctcggtgacgagacttcctacttcgtgccccgctctaacaccaatctccatgatgtccgcctccttgcgattcggagaatccactccgccgcgctgaccacttccggtgacgtcttcacctggggttatggtggatttggagctcc

SEQ ID NO: 35295 - protein, 108 aa, Zea mays
  misc_feature: Ceres CLONE 1414564-F
MFHRLLPHRRYISTSPASNSKPTLYSDGTIPFSILSWGRAVSAQLGGDKDERRLYPSHVAHLLLPKSDPRLAPTPGRLPSAEDTPGAEVGISCGILHSSLLVEGGLWE

SEQ ID NO: 35296 - DNA, 704 bp, Zea mays
  misc_feature: Ceres CLONE 1414565-F
  misc_feature: Encodes the peptide sequence at SEQ ID NO. 35297
aagctggagctccccgcggtggcggccgctctagaactagtggatcccccgggctgcaggaattcgcacgagaccattacctagaacatcctaatcaaaaaacaaaaaataaggatgcgttctccggcaaacccggatccctcgcgatccacgccgacacctagctgcgctgccaccgtccacatcatcatcccccactgggactccccgcccccgctcccactcccatacgctcgccgatggggcgggctttccggaacatcgctgatccgcctgtcactcacaccgatcaacaatcaagtcatcgaggaggacgatgcaaaagcagaccaggacaagaacgagggcataaaagcttgcttcgacagggttaacatgggtgaggaaataactttctcccccgaaaagaaatcttgcgccttgccggcaaaatgcacatagaaaaggtcgatggccggggaaaaatagagggcgttgggtggaaaaaagtgcatcctcacagaaagaagggtgggcaagaaaaccaataaaatagaatggttagaatgcgaggactaaatattgcgactaaatggtaaccaagaataccagtagggaggaggttaaaccacatgaaccgaggctcgggcagttaagtccgcctcaaaacaaaatggggggttatcagaggaaatggaagtctttcccttaagcgatggagatag

SEQ ID NO: 35297 - protein, 108 aa, Zea mays
  misc_feature: Ceres CLONE 1414565-F
MRSPANPDPSRSTPTPSCAATVHIIIPHWDSPPPLPLPYARRWGGLSGTSLIRLSLTPINNQVIEEDDAKADQDKNEGIKACFDRVNMGEEITFSPEKKSCALPAKCT

SEQ ID NO: 35298 - DNA, 754 bp, Zea mays
  misc_feature: Ceres CLONE 1414565-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (20)..(20): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
nnnnttcccggtgcgggacnccaacaaaaaactaaccactaaannnngggnnnnnnaaacgaattgggtaccgggccccccctcgaggtcgacggtatcgataagcttttttttttttttttttggcctcaatccaaaatgtcattggtaaaaatgtttggaagttgctgtatgttaaaagtaattaattgtaaagttgacaacaccgggcataaggggaggtacatctttgcctataatagcataatgtttcttctcgcctagacgaaaagataagggatcctccaaacagaaaggaaacgcccttgcttatcgtcccatacgaccaaaatcccccacttgataaatagctcaagaagcatcgatgaagagaaagaaataacatctttcttgaagtaaaacgaacaaggagaaagatggtttaaaaaaaaatgtaaagctaactaagcaccgatggcaacccttcagcccctcccccccggggactgtgcattctccgccaagatactagacataatatctggttgcttgagtatccctccgattttaagctctccatcatgtcatcaggggcctttctggctgacaacccctcctttgttcttggatcttgtccagaatgcgaaaacgcacagctcccgactaattctttcggagataaaagggcctcccagaacttgtgtcttaggggaaaagaacctttacttcagaaagggctcttcctaaacgccaaaaattctttgccacactttca

SEQ ID NO: 35299 - DNA, 722 bp, Zea mays
  misc_feature: Ceres CLONE 1414569-F
  misc_feature: Encodes the peptide sequence at SEQ ID NO. 35300
aaagctggagctccccgcggtggcggccgctctagaactagtggatcccccgggctgcaggaattcgcacgagaccattacctagaacatcctaaaaaaaaccttaatcctatactttcatcgggcgcggcgtgccccctcgcctccaaggctccaacgcatcaatcaatagagcgagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgagacatcctctctcgtggtgctcggtcccgtggtggggacgctcgttggaagggccacataccttcaggttttgggcatctggctgctgtcgcaaagcatatccttgattgtcgctggaacctcggtgaccaccctgctcatgtatgccaacctgagagccacaagcttcccggcattcatggcgctggtcgccgttaccaacgtctccggcgctctagctgccctctcagctctcgccggcaccatactgatcgagagagaatgggtggtggtgatctcgagcgggcatcctccgtcggtgcggacggggatcaactcggtggtccggcggatcgacctgggctgctcgctgctggcccccgtgctgtcgtctctcgtcatcagcctcgcgtcg

SEQ ID NO: 35300 - protein, 135 aa, Zea mays
  misc_feature: Ceres CLONE 1414569-F
MGRETSSLVVLGPVVGTLVGRATYLQVLGIWLLSQSISLIVAGTSVTTLLMYANLRATSFPAFMALVAVTNVSGALAALSALAGTILIEREWVVVISSGHPPSVRTGINSVVRRIDLGCSLLAPVLSSLVISLAS

SEQ ID NO: 35301 - DNA, 640 bp, Zea mays
  misc_feature: Ceres CLONE 1414576-F
  misc_feature: Encodes the peptide sequence at SEQ ID NO. 35302
atagctggagctcaccgcggtggcggccgctctagaactagtggatcccccgggctgcaggaattcgcacgagaccattacctagaacatcctaatcgaaaaacatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatcttcgtcatgcgcctcgtcccgcaccccaacgtcgtgcagctgcacgagggtgatggcccagaaaaaaaagaattacttcccccatggagaacgtccggggcggagaagctctttccccggggtcccccggggccggtctaaaggaggaccc

SEQ ID NO: 35302 - protein, 107 aa, Zea mays
  misc_feature: Ceres CLONE 1414576-F
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVGMIDQIKREIFVMRLVPHPNVVQLHEGDGPEKKELLPPWRTSGAEKLFPRGPPGPV

SEQ ID NO: 35303 - DNA, 689 bp, Zea mays
  misc_feature: Ceres CLONE 1414578-F
  misc_feature: Encodes the peptide sequence at SEQ ID NO. 35304
gctcttaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgccgccatgaaggcgctcaagtcgtaccgccagacacctggactccaagtccatcccgcacttcctcgccgaggtctccgacaccaccgcggtcggcgccggcgcccggcagcggcatgcccaccggcggggagtccaccatctcgctctacaaggtgctggcgcgggttggacggcccaaacatggtggcggaaaacgggaaactcctgggcccacatcttggggcaccgtctccccccggggggggttcctttcccggctccacaggcctgggccccagggggggggcccgccaatccggggggccggggatttaaaccccccccggccccaaggggaaaaaaaggcgggtattcttccccttccccttctgtgggggcctctctgtaaggcgcttttttgg

SEQ ID NO: 35304 - protein, 129 aa, Zea mays
  misc_feature: Ceres CLONE 1414578-F
MGRSLSPLLRQELDNLDKDADSRRAAMKALKSYRQTPGLQVHPALPRRGLRHHRGRRRRPAAACPPAGSPPSRSTRCWRGLDGPNMVAENGKLLGPHLGAPSPPGGGSFPGSTGLGPRGGARQSGGPGI

SEQ ID NO: 35305 - DNA, 694 bp, Zea mays
  misc_feature: Ceres CLONE 1414590-F
  misc_feature: Translation starting site: 311
  misc_feature (404)..(404): n is a, c, t, g, unknown, or other
  misc_feature (406)..(406): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (429)..(429): n is a, c, t, g, unknown, or other
aaagctggagctccccgcggtggcggccgctctagaactagtggatcccccgggctgcagtaattcgcacgagaccattacctagaacatcctaatcaaaactccactgctctgctgctcctcgcgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctctgggcgaggtctatggccaccttcacgcgcacgaagccccatgtgaacgtcggcaccattgggcacgtcgatcacggcaaaaccactctcactgctgccattaccnanggtctgnnncgagcagggaaggncaagccgttgctttcgacgagatcggacaggctccggaggagaaagccagagggatcaccattgcgacagctcacgtcaaggatgaaaccggctaaaagcattatggtcaccgtgattgtccaggcccgcaaattattgcagaacatgatcccgggagtggctcaaaggaaggggggaattcttgccgggcacctcctgaggccccatgccaaactataggggaatttctttttggcccgaaggggggggaccttcccctggggg

SEQ ID NO: 35306 - DNA, 679 bp, Zea mays
  misc_feature: Ceres CLONE 1414596-F
aaagctggagctccccgcggtggcggccgctctataactagtggatcccccgggctgcaggaattcgcacgagaccattacctagaacatcctaatcgaaaaactcttcccttcctgcatttcctcctctgtctcatcggggacccctgtccctcgtggcgacggccggtcgaccgccgctgccgaggacttcgccggcgacgaccacccccacgcccactacattatatgttgaagaatggcttggagctaacagtactgacaccaacttttggttatgatcagaagcgactggagtgcagtaatgaatctctaattgtttgcaatataagaaccagatacctcattcaaatggtttttccatgttacagattggtagcccagaacaaagagaaaacccccaacagtaatgggtcacgaccatatgtctcgtataaagatgcatatggcagaaaggttctttttggtgacaggatcccggtgccagcaaacctgggtgcgaatgaaggttggccaaaagaagggtaagtggacctgcaaaaatccccaggggaaaaggtggccatgccaaccacgttcagttaccctcccgaaagggggaattgggaaagcctccaagttttattttggggcccccctcggttaacccaccccccatttttaaagggattttgttttc

SEQ ID NO: 35307 - DNA, 730 bp, Zea mays
  misc_feature: Ceres CLONE 1414598-F
  misc_feature: Encodes the peptide sequence at SEQ ID NO. 35308
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
gggccccccccccccccccccgccccgggggggncnntcctnnnnttnacaaagctggagctccccgcggtggcggccgctctagactagtggatcccccgggctgcaggaattcgcacgagaccattacctagaacatcctaatcaaaaattcttgcgacggaagctaaatctgcacgagagacagacgacgagatggccgatgcggaggacgccgccgccgcgcgccgacgggccgccataaccgactacggcaagaagctgctcaactgcaggcagctcgagtcgcgcgtcggcaccgtgagagaaagccttaaaaatgcagagagggattttaccatgactgaagacgacttgaaatctctgcagagcgtgcgacaaataattggagaggttctccgacctcttgataatggaacgctttattgtgaaggccagtagcgttccccgatatgtggccggctgccgaagtatggcatacaaggagaagttgacatctggaactcgagttgtacttgacatgacgaccttgacaatactgcgcactcttccacggaaggaggatccaggggaatataacatgcttcatgaagatccagaacatgtgagctactctggtgaaggcggtttgtctgatcagattagggagctcagggagtccattgggttgccagttatgagccctgaactctttccttggggggggaaataaggccccctaggggtggtc

SEQ ID NO: 35308 - protein, 99 aa, Zea mays
  misc_feature: Ceres CLONE 1414598-F
MERFIVKASSVPRYVAGCRSMAYKEKLTSGTRVVLDMTTLTILRTLPRKEDPGEYNMLHEDPEHVSYSGEGGLSDQIRELRESIGLPVMSPELFPWGGK

SEQ ID NO: 35309 - DNA, 663 bp, Zea mays
  misc_feature: Ceres CLONE 1414604-F
  misc_feature: Encodes the peptide sequence at SEQ ID NO. 35310
  misc_feature (462)..(462): n is a, c, t, g, unknown, or other
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaagggcgtctacttcctccgaccctnccgctacaacgtccagaagctccgcaggcacctcgncatgccgcgctttccccgagtaccacctaattcttctccaggatatttgaagggtcccgaaaaatcaaataacttgcttgaatccggaagaaccaggagggttgggcaacaaaagttcaggagttccaaagggcggattttttggggccccttggccccttaccc

SEQ ID NO: 35310 - protein, 142 aa, Zea mays
  misc_feature: Ceres CLONE 1414604-F
  misc_feature (76)..(76): Xaa is any aa, unknown, or other
  misc_feature (88)..(88): Xaa is any aa, unknown, or other
MVLITLVRDYIDRMLHDIPGMKVLVLDPQTVGMVSVVYSQSDLLRKEVFLVETMDNASSSRESMAHLKGVYFLRPXRYNVQKLRRHLXMPRFPRVPPNSSPGYLKGPEKSNNLLESGRTRRVGQQKFRSSKGRIFWGPLAPY

SEQ ID NO: 35311 - DNA, 673 bp, Zea mays
  misc_feature: Ceres CLONE 1414609-F
  misc_feature: Translation starting site: 209
  misc_feature (506)..(506): n is a, c, t, g, unknown, or other
  misc_feature (537)..(537): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcgaaaactacatcctcggtcagtgctcagtagtcatttgtgtccattgccgctctgctttgtgctcgctctgtttgtttgttgtcgactccattgacggccgctgatacttacatggttgatggttcagcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacnaggatgtgtgccacccgacggacgcgcaggncggcggtggtgttcgtgacgctgtacctcatcgcgctgggcacgggcgggatcaagccgtgcgtgtcctccttcggcgccgaccagntcgacgagtacgacgagcgggagaagaaagagcagagctccttcttcac

SEQ ID NO: 35312 - DNA, 767 bp, Zea mays
  misc_feature: Ceres CLONE 1414611-F
  misc_feature (313)..(313): n is a, c, t, g, unknown, or other
gctctagaactagtggatcccccgggctgcaggaattcgcacgagaccattacctagaacatcctaatcgaaaaacaaaagcgagagcaaagcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgacagggaggagcgagggagcgcgcggctagagaaggcggggcggcgggaggaaggaaggaaagagccgcccgccggnagcaaacgttcccctcggggccctccgggcggaatgagatcgaagaaggaaggcggcagccacgcccaacgggggggggggaagcaggaagcccctttccttgagggtcctaacggggctacagggttgggcctttatataacctttccttctccgggggctccctactttaaacgggaatttcctcccccccaaggtggggaccgggcccctattttttccataccaggacctccgcggggtaaaaggcgcgcccccacaaaaaaaacgccagtcggggggcgcccccccccggccgcgctcaaaacccctctgccccccccccaaacgggatccccccccaaccccaccaagattgacaaccatcccgcacaaagggcacatctgcccactaccaaccccccccgctgcagtacggtcttacataaaagaagtggaggcccctctaccccct

SEQ ID NO: 35313 - DNA, 678 bp, Zea mays
  misc_feature: Ceres CLONE 1414614-F
  misc_feature: Encodes the peptide sequence at SEQ ID NO. 35314
aaagctggagctccccgcggtggcggccgctctagaactagtggatcccccgggctgcaggaattcgcacgagaccattacctagaacatcctaatcgaaaagacaaccccagcgcacgaactccaaaatagcgagccgaagggggccacgagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttggaggacgagcaaaccctagccagctacggtgtggagacagaccatacaatccacatggtacgtggtgctgtgccatcaccaacatctactgcacctgcagccaaccaagaacctaccactgctgctcctgccagttccccggaacaggattgggtggtttgttgcaaagtctgggtactacaggcgctgctgctacagtgaggggttggggtttggttgga

SEQ ID NO: 35314 - protein, 132 aa, Zea mays
  misc_feature: Ceres CLONE 1414614-F
  misc_feature (22)..(90): Pfam Name: ubiquitin Pfam Description: Ubiquitin family
MGGGDADAGGEPADAQATLHIRCTNASKFTVRADLGATVGAFKAIVADSCDVPAPQQRLIYKGRILEDEQTLASYGVETDHTIHMVRGAVPSPTSTAPAANQEPTTAAPASSPEQDWVVCCKVWVLQALLLQ

SEQ ID NO: 35315 - DNA, 669 bp, Zea mays
  misc_feature: Ceres CLONE 1414618-F
  misc_feature: Encodes the peptide sequence at SEQ ID NO. 35316
  misc_feature (502)..(502): n is a, c, t, g, unknown, or other
aagctggagctccccgcggtggcggccgctctagaactagtggatcccccgggctgcaggaattcgcacgagaccattacctagaacatcctaatcgaaaaatcgattcattcaactgaacagcaagcgcacctaccctacccgccgccgccgaaggcgaaggcctagctcccggtccggcgcgatggctgccgcggcccgccgcggcccgccgcggccccggggcgctcctcctcgtggcgctcctcctgctggcgctggtcgtctccgggcactgcctggacgcgcaccaccgcgggctgaagcgccgccggcggaagcacgagattcactctccgatcaagacggtggtggtcgtggtgatggagaaccgcagcttcgaccacatcctcggctggctccgccacacccgccccgacatcgacggcctcacgggccgcgagtccaaccgcctcaacgcctccgacccctcctccccggatatcttcgtcacggacgaggncggctacgtcgactccgaccccggccacggtttcgaggacatccgggagcagatcttcggctcccgcgacacctccgcggtgcccgcgcccatgtccggcttcacccagaacgcgcgcggcatgggcctcggcatggcgcagaacgtcatgagcgggctcaagcccg

SEQ ID NO: 35316 - protein, 102 aa, Zea mays
  misc_feature: Ceres CLONE 1414618-F
  misc_feature (47)..(47): Xaa is any aa, unknown, or other
MENRSFDHILGWLRHTRPDIDGLTGRESNRLNASDPSSPDIFVTDEXGYVDSDPGHGFEDIREQIFGSRDTSAVPAPMSGFTQNARGMGLGMAQNVMSGLKP

SEQ ID NO: 35317 - DNA, 668 bp, Zea mays
  misc_feature: Ceres CLONE 1414620-F
  misc_feature: Encodes the peptide sequence at SEQ ID NO. 35318
  misc_feature (409)..(409): n is a, c, t, g, unknown, or other
aaagctggagctcaccgcggtggcggccgctctagaactagtggatcccccgggctgcaggaattcgcacgagaccattacctagaacatcctaatcgaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaaccaacaggaggaaaggcaaggcngaggtcaaggggggcgccgccgccgccgccggccggcgaaagccccagcggaaatcccgggaaggatcttcggcgggagggttcccgggggaaaaccacggatggttaattttgggagggcattttggaaaagaagggaaaaaaaattttgtttccgggggataaggagaggaaagggccccctttctccccacccggggttttgggtttttttaaaaaaaccccgccccggggtgtgttttaaaaaagagaaaaaaag

SEQ ID NO: 35318 - protein, 110 aa, Zea mays
  misc_feature: Ceres CLONE 1414620-F
  misc_feature (30)..(79): Pfam Name: Ribosomal_S27e Pfam Description: Ribosomal protein S27
  misc_feature (75)..(75): Xaa is any aa, unknown, or other
MVLQNDIDLLNPPAELEKLKHKKKRLVQSPNSFFMDVKCQGCFSITTVFSHSQTVVVCPGCQTVLCQPTGGKARXRSRGAPPPPPAGESPSGNPGKDLRREGSRGKTTDG

SEQ ID NO: 35319 - DNA, 670 bp, Zea mays
  misc_feature: Ceres CLONE 1414624-F
  misc_feature (322)..(322): n is a, c, t, g, unknown, or other
  misc_feature (323)..(323): n is a, c, t, g, unknown, or other
  misc_feature (336)..(336): n is a, c, t, g, unknown, or other
  misc_feature (340)..(340): n is a, c, t, g, unknown, or other
  misc_feature (343)..(343): n is a, c, t, g, unknown, or other
  misc_feature (344)..(344): n is a, c, t, g, unknown, or other
  misc_feature (539)..(539): n is a, c, t, g, unknown, or other
tggagctccccgcggtggcggccgctctagaactagtggatcccccgggctgcaggaattcgcacgagaccattacctagaacatcctaatcgaaaacgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtccgcgctacnngccggggcgcggncggncgnngaggaactctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggnatcctcgcgctcctcgactcccacctcgtcccatccgccggcggcgccgagtccaaggtcttctacctcaagatgaagggtgactaccacaggtaccttgctgagttcaagtcaggtgcagagaggaagga

SEQ ID NO: 35320 - DNA, 688 bp, Zea mays
  misc_feature: Ceres CLONE 1414625-F
  misc_feature: Encodes the peptide sequence at SEQ ID NO. 35321
aaagctggagctccccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcgaaggacggcgtcatcaactcgccccccgcggtgctgggcggcgccagctgcatcaacgccggtttctacacgcgggtcagcgacaactaagtgacggggcgaccgggtggaaactgggccccccccggtgcgcccttcccggtggagtggaaggacgagcttggccgttccaacccggaacctgtgggccctgggaaggcccccc

SEQ ID NO: 35321 - protein, 141 aa, Zea mays
  misc_feature: Ceres CLONE 1414625-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSKDGVINSPPAVLGGASCINAGFYTRVSDN

SEQ ID NO: 35322 - DNA, 799 bp, Zea mays
  misc_feature: Ceres CLONE 1414629-F
  misc_feature: Encodes the peptide sequence at SEQ ID NO. 35323
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (18)..(18): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
nnnnnnnnnccccccccnccnccccccnncccccgtnnngtgtggggggtcaatactggagctccccgcggtggcggccgctctataactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggccctcctaattgtcgcatgcgctgccaccgccgccaccgccgccggcaccgtccccttctacccgtccgcgaaatccgcccgccgccgcgcactgcgaacggcacgctgtacccggagctctgcctggcgacactcgcggacatcccgggaacctaacacaaagaagcccggtcccggaagtcaatcttggcgcgggccgggaaccgaacccgaaggaacgggggggtcagccccggtcccagcaagctgcttcgtactaccctgcaaggacaggtcccctggtcggccgccgagaaccgccccggcccattcaaaagaacgggcctggaaagcttgcttggtccacccatcgaggggagggaagttcccgcggccaagaacccgccagaacctgtggagaccccccccaaccgaaaaaggcgaagacgcgcccgtacagccggtgccgtggttacccaagggcccgcccaag

SEQ ID NO: 35323 - protein, 170 aa, Zea mays
  misc_feature: Ceres CLONE 1414629-F
MPPIPKRGEHLLALLIVACAATAATAAGTVPFYPSAKSARRRALRTARCTRSSAWRHSRTSREPNTKKPGPGSQSWRGPGTEPEGTGGSAPVPASCFVLPCKDRSPGRPPRTAPAHSKERAWKACLVHPSRGGKFPRPRTRQNLWRPPPTEKGEDAPVQPVPWLPKGPPK

SEQ ID NO: 35324 - DNA, 702 bp, Zea mays
  misc_feature: Ceres CLONE 1414631-F
  misc_feature: Encodes the peptide sequence at SEQ ID NO. 35325
aagctggagctccccgcggtggcggccgctctagaactagtggatcccccgggctgcaggaattcgcacgagaccattacctagaacatcctaatcgaaaagaagaaagctgccggcctgccgctgcctgctcgcagttgccagcccccgccgccgcggaggacggaaggaagcgaatcaaccgcgactgtctccgacgggaataaagcaggcgaggccagccggtcgcggaacccccaattctcagctgcggccggcgatcgagtcggttccgtcccgcgccgatgcggatcccgcggcggaagggcggggccgggccgctcgctgtcggggtgcccagcaggcgggcgcaggtcgccgcggtcttcgcgctcgccgaactgctgggggtctccgtgctctacgacaacgcccacatcgccgcctcgctgcggaggcacgtcggcccgaggacgtacgcaagtctcttccccttcgaagggaccatcgttgtccccagcatggccaaggaagagacgtcgggggcttctgcctcggagcaatacattcgcggaagagagcgaggtgtcggctttgatgatactcctccacatacatgatccgtcaggggcgaaaaaacagttcccgaggccctccaggcttggagccacgggttctggagccccctgggaagagaatggaccaaccccccgggggggggtg

SEQ ID NO: 35325 - protein, 104 aa, Zea mays
  misc_feature: Ceres CLONE 1414631-F
MRIPRRKGGAGPLAVGVPSRRAQVAAVFALAELLGVSVLYDNAHIAASLRRHVGPRTYASLFPFEGTIVVPSMAKEETSGASASEQYIRGRERGVGFDDTPPHT

SEQ ID NO: 35326 - DNA, 698 bp, Zea mays
  misc_feature: Ceres CLONE 1414632-F
  misc_feature: Encodes the peptide sequence at SEQ ID NO. 35327
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (422)..(422): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcaaaaaaagtcccaatccaccgacgaattccaaaccctgcctaggacctcggcgccactcgccgcacgtcgtccacgtccgcctccaccccaatccgatgggctatgaagagagcaaaaaacatctcctcagtctcagctaccctgagctgcaatgtttgtgcaaaaggtataaccttcctgctaagaagacccactctcagttagcaagttcgctcgcctcgctgcttgaggcatctccatctcctgctcctccctctgtccannntagcaatatgaaagaagcatccacatgcaatcatgctaacaacaaaagaggcccatacnatgccagggatgatggtaaaccactgggcatgcgaaaactcaaaaagagatccgacccctgttgatgaaacttcaaaaaggggattggacactgggaccagaaatcccccggtttctttggaccgggaaaacccaaaaatttggggccatttattttttggcccggaaaatggctcaaattttacgcccccaatgggggggggggaattgcacaaaaaccaaaaaatttaaaatttgtggggaaaaaaaggtgttcccccccgacaaaaaaattan

SEQ ID NO: 35327 - protein, 97 aa, Zea mays
  misc_feature: Ceres CLONE 1414632-F
  misc_feature (56)..(56): Xaa is any aa, unknown, or other
  misc_feature (57)..(57): Xaa is any aa, unknown, or other
  misc_feature (77)..(77): Xaa is any aa, unknown, or other
MGYEESKKHLLSLSYPELQCLCKRYNLPAKKTHSQLASSLASLLEASPSPAPPSVXXSNMKEASTCNHANNKRGPYXARDDGKPLGMRKLKKRSDPC

SEQ ID NO: 35328 - DNA, 872 bp, Zea mays
  misc_feature: Ceres CLONE 1414635-F
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
gggccccnnntcccnnnnncctcctcacaccctcacctcccacactccaaactggagctccccgcggtggcggccgctctagactagtggatcccccgggctgcaggaattcgcacgagaccattacctagaacatcctaatcgaaaattgttgattgattgatcctccccgcctcactcctttgtctcctcgcctcgtgctcgctcgctcccctcgccctggcgaggagggcaccaagaaaccctagcggctcagggcgggcggtggttagatgctccaaggttcgagaggaaaggttatgttatcgttgcctcatcgaatatgggctgccccttccgaccggaagaatgcctactcctttgcacccgccctaacaacaaaatggcccaagggtgaaggtccctcccccgcagaccccaaaccgaggttccgcccttccgctatcgtccaaccaccgtaccgttacccgtcgaaggcccgcgcgactgtcggtttcgaggggtcacccaagctccgtccggacccccctccgcggacacgggcttctctcccgcccgccgtacttgcccctcggcacgtaaacaagcgctgcgccctaccgtactatggtaccaaccggtggcatcccgttctcctctacatatctccgccatcagtccctcctccgggcggtctgactcaagacccctctcctgaggactcaacaacaccctccaatgatatatcctaatacagcaaacatgggctcccacccccggacacaaacaaaacttactaaacccgcaatcaaagtgccacccacacactccaatatcgacagatcgctacaattctccattattaccgccacgtcccccccacttaccccctg

SEQ ID NO: 35329 - DNA, 724 bp, Zea mays
  misc_feature: Ceres CLONE 1414641-F
aaagctggagctccccgcggtggcggccgctctagaactagtggatcccccgggctgcaggaattcgcacgagaccattacctagaacatcctaatcgaaaaaacggtgtcctgcacttgcacccctatgccgtcgccgcggcggcagcggcattgatctcggcgtacatggtgtggttctgggcgctgacgcgacggctgtccgggccgcggatgtggcccctcgtcggcagcctgcccagcgtcgtcctgaatcgggcgcgggttcacgactggatcgtcgacaacctgcgctccaagggggaagcggtcacgtaccagacgtgcatcttgccgctgccgttcttggcgcggcgccaggggctggtgaccgtcacgtgcaacccgcggaacctggagcacatcctgcgcgcgcgtttcgacaactaccccaagggccccatgtggcaggcggcgttcccacgatctcctgggccaaggtatcttcaactcccacggcgagacgtggctgctccagcgcaagacggcggcgctcgagttcaccacgaggaccttgcgccaggcgatggggcgctgggccaaccgcatcatcaagtacccgctgtggagaatcctcgcagaccactgcgaggccgggggggagcgtcaccctcaaggacctgtttttgcgcctcaacttccaaaaaatctggggcctcaccttcggaaaggaccccaagacccg

SEQ ID NO: 35330 - DNA, 765 bp, Zea mays
  misc_feature: Ceres CLONE 1414642-F
  misc_feature: Encodes the peptide sequence at SEQ ID NO. 35331
aaagctggagctccccgcggtggcggccgctctagaactagtggatcccccgggctgcaggaattcgcacgagaccattacctagaacatcctaatcgaaaagtgtcctgtgccagttgattcgccttctgaagttctgaaacgcagcggagcgtgccggaggagagcatagcgtagagtggaggatagagacagcagaacaccagatcagatcagatggcccctccgtctccccagccgtcgctagtgcgcgtgctcgaccgcatccgcgtctcgccgccgccggctgattctgagcaagagcccgcgctccccctcactttcttcgacgtgggctgactcttcacaggaccgtcgaagggctcttcttcttccgccacccggaggacggcttcaatctgccgttcctcggctcctcggtctgccttcgagttccgccgtttctacccattcggcggaccattgggtccccaaagcccttcttttggtctaacctcgtggaacgaatgcctcacctgtggctcccccaggcaaaaagccccgagatttcccacggcctcaaagcccggtcgcccagggaactggaggggaacccccccctctttttccaaaatggcccccctcgggggaaaaaaggaggttttcccgttcccgctcttggagggtatttttttttcccggagaggaggcttttggccccggggggtgtcccaaaacaactgtgtgtttggggggatgttcctccccgggggtttttttgggcaa

SEQ ID NO: 35331 - protein, 51 aa, Zea mays
  misc_feature: Ceres CLONE 1414642-F
MAPLGGKKEVFPFPLLEGIFFSRRGGFWPRGVSQNNCVFGGMFLPGGFFGQ

SEQ ID NO: 35332 - DNA, 728 bp, Zea mays
  misc_feature: Ceres CLONE 1414645-F
  misc_feature: Encodes the peptide sequence at SEQ ID NO. 35333
  misc_feature (515)..(515): n is a, c, t, g, unknown, or other
  misc_feature (523)..(523): n is a, c, t, g, unknown, or other
  misc_feature (541)..(541): n is a, c, t, g, unknown, or other
  misc_feature (542)..(542): n is a, c, t, g, unknown, or other
  misc_feature (633)..(633): n is a, c, t, g, unknown, or other
  misc_feature (669)..(669): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagcatcctaatcaaaaaaagtctctcaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgtgcctggcgntgatcggnctgctcctcgccaacccnngcgggtcaggtcgtgcccagggccactttcagctcctgagcaagctcgtcttcgcgctcttcctccccctgctcatctcgtccacctcggnaaagtcgtcaccatagacacgtcctgcactggtggntcatccccgtcaacgtgctcatcagcactgccatcggntgcgccctgggtacatcgtgg

SEQ ID NO: 35333 - protein, 73 aa, Zea mays
  misc_feature: Ceres CLONE 1414645-F
  misc_feature (30)..(30): Xaa is any aa, unknown, or other
  misc_feature (39)..(39): Xaa is any aa, unknown, or other
  misc_feature (69)..(69): Xaa is any aa, unknown, or other
MVWSMDPQVTVHGDWVSAVVPLMKLLCLAXIGLLLANPXGSGRAQGHFQLLSKLVFALFLPLLISSTSXKSSP

SEQ ID NO: 35334 - DNA, 749 bp, Zea mays
  misc_feature: Ceres CLONE 1414649-F
  misc_feature: Encodes the peptide sequence at SEQ ID NO. 35335
  misc_feature (343)..(343): n is a, c, t, g, unknown, or other
  misc_feature (355)..(355): n is a, c, t, g, unknown, or other
  misc_feature (356)..(356): n is a, c, t, g, unknown, or other
  misc_feature (379)..(379): n is a, c, t, g, unknown, or other
  misc_feature (380)..(380): n is a, c, t, g, unknown, or other
  misc_feature (385)..(385): n is a, c, t, g, unknown, or other
  misc_feature (386)..(386): n is a, c, t, g, unknown, or other
  misc_feature (395)..(395): n is a, c, t, g, unknown, or other
  misc_feature (423)..(423): n is a, c, t, g, unknown, or other
  misc_feature (494)..(494): n is a, c, t, g, unknown, or other
  misc_feature (495)..(495): n is a, c, t, g, unknown, or other
  misc_feature (544)..(544): n is a, c, t, g, unknown, or other
  misc_feature (546)..(546): n is a, c, t, g, unknown, or other
  misc_feature (547)..(547): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (638)..(638): n is a, c, t, g, unknown, or other
  misc_feature (646)..(646): n is a, c, t, g, unknown, or other
  misc_feature (648)..(648): n is a, c, t, g, unknown, or other
  misc_feature (672)..(672): n is a, c, t, g, unknown, or other
  misc_feature (688)..(688): n is a, c, t, g, unknown, or other
  misc_feature (689)..(689): n is a, c, t, g, unknown, or other
  misc_feature (695)..(695): n is a, c, t, g, unknown, or other
  misc_feature (713)..(713): n is a, c, t, g, unknown, or other
  misc_feature (714)..(714): n is a, c, t, g, unknown, or other
  misc_feature (731)..(731): n is a, c, t, g, unknown, or other
aaagctggagctccccgcggtggcggccgctctagaactagtggatcccccgggctgcaggaattcgcacgagaccattacctagaacatcctaatcaaaaaatcaccaagttttagactccagcagcggcatccccacccacccatctgctcagcctcagctgccattcccgcgaagcgccgtctcccgggccctatcgatggaccgcgtagccgccctcgccgtcgcgctcctcgccctcttcttcgccgccggggccacggcgcaggccccggcctcgtcgcccaagcgcactccggcgccagcgccgcccaggacggcttcctcccgccgccgcccggntgccaggggcgnnctatgggctccccgccctcgccnntccgnngatgggcgnccggtgccccgcggcccttccgcccggnggtgccggccacgaagcccccggccggggcccggtggttggttggccccgccgatggcccccccgcccggnngccgggggggggttctggcttcccggttggccgggccccgcccccgggngnnggggcgccccccgggttcctgttctccgcggggcgggggnnnnggccccgggggggcccctgtttggcggccggggggccccccccccggncggggggngnccccggggggggggcccctggggncccccccgtgtggggnntggggncccgcgggggggcccccnngggcgcgcccccctttncccggggggggggggtgt

SEQ ID NO: 35335 - protein, 183 aa, Zea mays
  misc_feature: Ceres CLONE 1414649-F
  misc_feature (48)..(48): Xaa is any aa, unknown, or other
  misc_feature (52)..(52): Xaa is any aa, unknown, or other
  misc_feature (60)..(60): Xaa is any aa, unknown, or other
  misc_feature (62)..(62): Xaa is any aa, unknown, or other
  misc_feature (75)..(75): Xaa is any aa, unknown, or other
  misc_feature (99)..(99): Xaa is any aa, unknown, or other
  misc_feature (115)..(115): Xaa is any aa, unknown, or other
  misc_feature (116)..(116): Xaa is any aa, unknown, or other
  misc_feature (130)..(130): Xaa is any aa, unknown, or other
  misc_feature (149)..(149): Xaa is any aa, unknown, or other
  misc_feature (150)..(150): Xaa is any aa, unknown, or other
  misc_feature (158)..(158): Xaa is any aa, unknown, or other
  misc_feature (163)..(163): Xaa is any aa, unknown, or other
  misc_feature (172)..(172): Xaa is any aa, unknown, or other
  misc_feature (177)..(177): Xaa is any aa, unknown, or other
MDRVAALAVALLALFFAAGATAQAPASSPKRTPAPAPPRTASSRRRPXARGXLWAPRPRXSXDGRPVPRGPSARXCRPRSPRPGPGGWLAPPMAPPPGXRGGVLASRLAGPRPRXXGRPPGSCSPRGGGXGPGGAPVWRPGGPPPGRGXXPGGGPLGXPPCGXWGPAGGPPXARPPXPGGGGC

SEQ ID NO: 35336 - DNA, 767 bp, Zea mays
  misc_feature: Ceres CLONE 1414650-F
  misc_feature: Encodes the peptide sequence at SEQ ID NO. 35337
  misc_feature (490)..(490): n is a, c, t, g, unknown, or other
  misc_feature (505)..(505): n is a, c, t, g, unknown, or other
  misc_feature (621)..(621): n is a, c, t, g, unknown, or other
  misc_feature (684)..(684): n is a, c, t, g, unknown, or other
  misc_feature (703)..(703): n is a, c, t, g, unknown, or other
  misc_feature (723)..(723): n is a, c, t, g, unknown, or other
  misc_feature (750)..(750): n is a, c, t, g, unknown, or other
aagctggagctccccgcggtggcggccgctctagaactagtggatcccccgggctgcaggaattcgcacgagaccattacctagaacatcctaatcaaaaaacccaaaatcctacgcagagacatgagtggcggcggcggcggcggcggggaggaccggatcagcatcctcccggacggcgttatcggcgagatcgtcacccgccttcccaccgccgatgccgtccgcgttcaggtcctctctcgccgttggcggcacatatggatctcctgtccgttgaacctcgatctcggttccccaaactactacaccgactacaagcgcgtcgtgtccggaatcctcgcggcccaccctggcccctgccgccgcctcaaagttgactggccgtacgacgacggcgagtcgtacaaccactggctccagtctcccgccttggtcggtcttcaggagctcgggatcgagccagagtactcttccttgtggctagacnagacaacactgccgncggagagacaacacgagagcactgccagagcggtgcattattccagttcgctcccacgctgcgccttcctaaggattggctaccataccttccccctctgtcggtgccgtggcggncgctccgggttgcacacctcgagctcatctcgtttctgctgcgtgaacatctcggaagcacgnctcactggatgctcgccgnctgccctgtgctcaaacccnttcgtctcgaacggtgcacagggttcncccacagtccggatcaa

SEQ ID NO: 35337 - protein, 214 aa, Zea mays
  misc_feature: Ceres CLONE 1414650-F
  misc_feature (11)..(58): Pfam Name: F-box Pfam Description: F-box domain
  misc_feature (123)..(123): Xaa is any aa, unknown, or other
  misc_feature (128)..(128): Xaa is any aa, unknown, or other
  misc_feature (194)..(194): Xaa is any aa, unknown, or other
MSGGGGGGGEDRISILPDGVIGEIVTRLPTADAVRVQVLSRRWRHIWISCPLNLDLGSPNYYTDYKRVVSGILAAHPGPCRRLKVDWPYDDGESYNHWLQSPALVGLQELGIEPEYSSLWLDXTTLPXERQHESTARAVHYSSSLPRCAFLRIGYHTFPLCRCRGGRSGLHTSSSSRFCCVNISEARLTGCSPXALCSNPFVSNGAQGSPTVRI

SEQ ID NO: 35338 - DNA, 736 bp, Zea mays
  misc_feature: Ceres CLONE 1414652-F
  misc_feature: Translation starting site: 270
  misc_feature: SWISSPROT Homolog: EC 3.6.3.14 H(+)-transporting two-sector ATPase
  misc_feature (736)..(736): n is a, c, t, g, unknown, or other
atagctggagctccccgcggtggcggccgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggtctctggacctgtggttgtggctgatggaatgggtggtgctgccatgtatgaacttgttcgtgtcggacatgataacctcattggggaaattatccggtcttgagggcgattcagctacaatccaagtttatgaggaaacagctggactgatggttaatgaccctgtattgagaacaagaaagcctctttcagttgaattgggacctggaattcttggaaaaatttttgacggtatccagcgacctctagaaacctcggtattaaggcaggagaggggatattcctcggggggggtttcaggtcctgccttggaaaagagggtttggggggaatttcagccacgaacctgaggggggggggaatggctccccccgggggggggatctatccccctccgggttttggaaagaccctttggggggggcgcatggttggtctttcccccggggtgttn

SEQ ID NO: 35339 - DNA, 786 bp, Zea mays
  misc_feature: Ceres CLONE 1414653-F
  misc_feature: Encodes the peptide sequence at SEQ ID NO. 35340
tggagctccccgcggtggcggccgctctattactagtggatcccccgggctgcaggaattcgcacgagaccattacctagaacatcctaatcgaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgcccctacgacgacgaccgcatcggggacatggcccgcttcgcggacacgcttgtcggacacctcccccgggctcgccccgcgcagggatttcgtgtcagaaggaaggagtcattaactcgccgccgcgggttgttgggccggcggcaactggatcaaacgccgggtttctaacaccgcggccatccaacaaataacctgcagatccgtccggtgggaacctgggcccccccccggggacgctcaacccgcggttcggaagaaattggtggcctttccaacccgaatttggggccctgtgcaggccccccttgacaggacggccctggttcaaggcccggggtccgcacccggaaaaagggtttacacctatcgacctatttccagagggaaccaaaggccc

SEQ ID NO: 35340 - protein, 145 aa, Zea mays
  misc_feature: Ceres CLONE 1414653-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLERGASPLRRRPHRGHGPLRGHACRTPPPGSPRAGISCQKEGVINSPPRVVGPAATGSNAGFLTPRPSNK

SEQ ID NO: 35341 - DNA, 690 bp, Zea mays
  misc_feature: Ceres CLONE 1414654-F
  misc_feature (327)..(327): n is a, c, t, g, unknown, or other
  misc_feature (361)..(361): n is a, c, t, g, unknown, or other
  misc_feature (435)..(435): n is a, c, t, g, unknown, or other
  misc_feature (436)..(436): n is a, c, t, g, unknown, or other
  misc_feature (486)..(486): n is a, c, t, g, unknown, or other
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcgaaaatcctttccgactcgccgccgtcgtctgctccggactgcgcctccactttggcctttgtcttttgcaaggtataaaaagagcaatgcgcttggtccgagacctaccgagaggaggctcatccggccgcatggagaatggtcatgggaagacttgacttgggacggtacaggcagacgtcccaaggtgaacgcggtgttgggtagcctctgtcgcttctactacccnagcatggtggagctcaatggcaagaggttcgcgnctatgcagtgggccgactggggtctgaaaggactatgtccccagccagggggagccagggggaaagcagtacgnngagggggaaagttcgaaacaaaaatgaaggacttggcaaggggcctgggnnggacgagttattgggggaaggtccaattggcggatggaatccaaggaggattaggtccttggggaccgggggaaaaaggacttttccgaaagggggttgaaaaagggaaacaagggatggccctggaaaatgggtcccattcgggggcctttataataaaaaaaagaaaagaaaagggggacaaaaattttcgcgaggttttt

SEQ ID NO: 35342 - DNA, 737 bp, Zea mays
  misc_feature: Ceres CLONE 1414658-F
  misc_feature (576)..(576): n is a, c, t, g, unknown, or other
  misc_feature (633)..(633): n is a, c, t, g, unknown, or other
tggagctccccgcggtggcggccgctctagaactagtggatcccccgggctgcaggaattcgcacgagaccattacctagaacatcctaatcgaaaaaaatagcattttttccccctgggagcccgagacgcagcgtgaggtgcggccccgtcccctcgccaccggaggagcaggacgacgaggtggcgtcggcgcgaggtagtcgcgcgcctgtaagagcggcggcatcggagtcgcaggcggaggcgaggaagtgaggggagagccctatagcctccgccgcggggcgtcgtgctcgctgcacgcactcccaccattttgtcccaactcgaagctcagactcgtgctgtcgtgctgtgcacgacccctcccctagtatcccaagctcctaactgagaacacaggagatgggaagagacggtgaacagactaggcgccggagccgcaagagatcccgcgacggatccccctcctcgtcggattccgattcgttcgactccccatcctctccgagcagtagccctgagcgacggagccgcagcagtaagcgatatagatcatcctcatcgcaccgncacagccgcaagaaaagcgaccggtcgcggagatcccgcgacgaggaccgccgtcgncgagaagacgtgacagcacagaaacgcaccgtgctgatggtgaaaggtcctcgactaccatccgtcgagagataggtcggatgagctcgaaaatcgtccagatt

SEQ ID NO: 35343 - DNA, 776 bp, Zea mays
  misc_feature: Ceres CLONE 1414659-F
  misc_feature: Encodes the peptide sequence at SEQ ID NO. 35344
  misc_feature (481)..(481): n is a, c, t, g, unknown, or other
  misc_feature (505)..(505): n is a, c, t, g, unknown, or other
  misc_feature (526)..(526): n is a, c, t, g, unknown, or other
  misc_feature (600)..(600): n is a, c, t, g, unknown, or other
  misc_feature (603)..(603): n is a, c, t, g, unknown, or other
  misc_feature (607)..(607): n is a, c, t, g, unknown, or other
  misc_feature (608)..(608): n is a, c, t, g, unknown, or other
  misc_feature (614)..(614): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
caaagctggagctccccgcggtggcggccgctctagaactagtggatcccccgggctgcaggaattcgcacgagaccattacttagaacatcctaatcgaaaacaatgatgggtttcgccatttcgaaacttgggaagaatattaaggcgatttcaagttcctttgcccaagatcacgatcaatatgttgttgaggaagtgaacaaaattggagaaaaagctgttatgtgtcatagactcaactttgaaaatgttgtgttttattgccaccaaatcaatgcaacaacaacttatatggttcctttggtagcatctgatggaactaaagctaaggcactaactatttgccaccatgatacaagaggcatggatcctattgtggtttatgaagttctcaaagttaagactggaaccgtgcctgtttgtcattttgttggcaacaaggctattgcttgggtacccaatctagtcactagtgaantcttggtgtggtctagttgctatnatattttgttggacactagtntttcatttaatggtttagtttttttttaaaattgtacacactgggttggaggacttacatggttggaacttganttnatgnntaaagntgatgggtctatggtatggagtatccttccatgtatttcaaaaaaaaatgggttttttttttcctttacccaaaaaaaaaaaaaaaaaaaagcttatcgatccggnnnnaacctctccagagggggggggccccgggtaccccatttcgccccttaataggg

SEQ ID NO: 35344 - protein, 149 aa, Zea mays
  misc_feature: Ceres CLONE 1414659-F
  misc_feature (1)..(120): Pfam Name: BURP Pfam Description: BURP domain
  misc_feature (126)..(126): Xaa is any aa, unknown, or other
  misc_feature (134)..(134): Xaa is any aa, unknown, or other
  misc_feature (141)..(141): Xaa is any aa, unknown, or other
MMGFAISKLGKNIKAISSSFAQDHDQYVVEEVNKIGEKAVMCHRLNFENVVFYCHQINATTTYMVPLVASDGTKAKALTICHHDTRGMDPIVVYEVLKVKTGTVPVCHFVGNKAIAWVPNLVTSEXLVWSSCYXILLDTSXSFNGLVFF

SEQ ID NO: 35345 - DNA, 775 bp, Zea mays
  misc_feature: Ceres CLONE 1414661-F
  misc_feature (293)..(293): n is a, c, t, g, unknown, or other
  misc_feature (294)..(294): n is a, c, t, g, unknown, or other
  misc_feature (336)..(336): n is a, c, t, g, unknown, or other
  misc_feature (344)..(344): n is a, c, t, g, unknown, or other
  misc_feature (350)..(350): n is a, c, t, g, unknown, or other
  misc_feature (358)..(358): n is a, c, t, g, unknown, or other
  misc_feature (425)..(425): n is a, c, t, g, unknown, or other
aagctggagctccccgcggtggcggccgctctataactagtggatcccccgggctgcaggaattcgcacgagaccattacctagaacatcctaatcgaaaaatctgtctatcttgatctcatctcctatcttcttcctcctagattctttcttccgcgcgccctctctctctctctccttcctgccttctgcctgcgggcggcccatgtccgtggcgcccctcctgccctgcgagctgcttctccagcgaaaaggttgctgcgccttgacgcaccaccgatccaccgccgccnnaccccgagcgtctgtccggcagctaggtagcgagctgcgcgntggctgcnaccggnaagcaggnaggggacagggcagcgaacgccgggcgattgccttgcttgcctgggggctccgcccgggcgagttgnccggcccgtcctggcagggatgacaaggaattatctccaaggccgacctggggtttttttaccagaagaggaggaacaccccggggcttttggggggggggggggggaaataaaaccccccccccgggggggggaatggttcccgttttttcccccgggcacaaaaaaaaaggcccccggggaattttaaaatttttggggggggctcccccccgggggtgtttacaaaaggccccccccccccccattttttgccccccccccgtgggggggccccggcccccccccccccggggggggcgccccccaaaaccccccggggggttaaaaaaaaagaggagccccccccc

SEQ ID NO: 35346 - DNA, 723 bp, Zea mays
  misc_feature: Ceres CLONE 1414667-F
  misc_feature: Encodes the peptide sequence at SEQ ID NO. 35347
  misc_feature (653)..(653): n is a, c, t, g, unknown, or other
atagctggagctccccgcggtggcggccgctctagaactagtggatcccccgggctgcaggaattcgcacgagaccattacctagaacatcctaatcgaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgacctttgtcacacctcggtaccatcgccaggtcggggacaaggagtcatgaaagccctgctgctggcgctgagggcctatgatgggcagttcggtgtcggttctactctggctactcgtcgcgaaagggtcgtcctgacccccagcataacgatgacgagcatacgtggggaaatcccgggggncgggtggttcctgttaacccggaaacgttggggaaaaacttggaaaggaaacaaaaataactttccccca

SEQ ID NO: 35347 - protein, 174 aa, Zea mays
  misc_feature: Ceres CLONE 1414667-F
  misc_feature (151)..(151): Xaa is any aa, unknown, or other
MATETETFAFQAEINQLLSLIINTFYSNKEIFLRELISNSSDALDKIRFESLTDKSKLDAQPELFIHIVPDKASNTLSIIDSGIGMTKSDLCHTSVPSPGRGQGVMKALLLALRAYDGQFGVGSTLATRRERVVLTPSITMTSIRGEIPGXGWFLLTRKRWGKTWKGNKNNFPP

SEQ ID NO: 35348 - DNA, 762 bp, Zea mays
  misc_feature: Ceres CLONE 1414668-F
  misc_feature: Encodes the peptide sequence at SEQ ID NO. 35349
  misc_feature (445)..(445): n is a, c, t, g, unknown, or other
  misc_feature (446)..(446): n is a, c, t, g, unknown, or other
  misc_feature (448)..(448): n is a, c, t, g, unknown, or other
  misc_feature (476)..(476): n is a, c, t, g, unknown, or other
  misc_feature (482)..(482): n is a, c, t, g, unknown, or other
  misc_feature (497)..(497): n is a, c, t, g, unknown, or other
aaagctggagctccccgcggtggcggccgctctagaactagtggatcccccgggctgcaggaattcgcacgagaccattacctagaacatcctaaaaaaaaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaaagtcggggacggaggacgcggacgccggnngncggggggtgtcgggagggcgaggctganggaggnacgacggcggcggcngtgaaggaggaacacgaggagggaggatgagggcgagctcgaggaaggggaatggatgcccagcatggaaggggttcgtgcgatacctggtggacagcaggctcgtcttcggaacatcgaagcgggtcgtggcgagtccaccgatgtcgcctgtgagtccagttctcatccccattctttgctgggaggggcattttgattaattggcggggcctgggattttccgaattagaatttcgggctcggcctttgattgcggatgtgc

SEQ ID NO: 35349 - protein, 127 aa, Zea mays
  misc_feature: Ceres CLONE 1414668-F
  misc_feature (111)..(111): Xaa is any aa, unknown, or other
  misc_feature (112)..(112): Xaa is any aa, unknown, or other
  misc_feature (121)..(121): Xaa is any aa, unknown, or other
  misc_feature (123)..(123): Xaa is any aa, unknown, or other
MPLIDAAASAVAPPPPRRVAQLRFFSTRRPGILSLTATSCSPSPPPPVAAEVPAAPQEAKSKPRPRRYPKQYPGESVGVAEEMRFVAMRLRNPKRTTIKDKVGDGGRGRRXXGGVGRARLXEXRRRR

SEQ ID NO: 35350 - DNA, 759 bp, Zea mays
  misc_feature: Ceres CLONE 1414669-F
  misc_feature (442)..(442): n is a, c, t, g, unknown, or other
  misc_feature (505)..(505): n is a, c, t, g, unknown, or other
  misc_feature (570)..(570): n is a, c, t, g, unknown, or other
  misc_feature (571)..(571): n is a, c, t, g, unknown, or other
  misc_feature (614)..(614): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
cagagctggagctccccgcggtggcggccgctctagaactagtggatcccccgggctgcaggaattcgcacgagaccattacctagaacatcctaatcgaaaaagggaggggaatcttcgtagagcactaggcagcgacggagtcagcgcagcttcgtctccttccttccttcccctttcgctggccgctggccgtcggcaccatcacctacggccacgggcgcagcgcggcgccgctccgtaccgggtccgcgggcctctcgccagggggacccgataagcctccgctgctctgctcggctgctcttaccgtctctcccgtccacggtccacttagctagaaacacacaacaaacaaggagaaatcgcaaggaggagcagcgcctgccgccgcgccgtatccagcgaggcagcccccccgccccgatctgccggcccgacnacgctgggatcttcctttccttagccgaccggtcaacgccgcagatattctccttcctgcggnctctgggaggtttccgtaaacccgtcaccccccctccttctattccttgcaggtatcgacgatannaacggagcagttgcttcaatctcgacttcgacctccatctgcngtgaaccattttggattttgnnnaaaaggggggggtgtttggcttgaattgcaacaggatctgcatcagttcacatttctttgggcatttgctatcctggccaagctggctgactaatacggttctgggttcaggaaacgcctct

SEQ ID NO: 35351 - DNA, 737 bp, Zea mays
  misc_feature: Ceres CLONE 1414672-F
  misc_feature: Translation starting site: 209
  misc_feature: SWISSPROT Homolog: EC 1.3.5.1 Succinate dehydrogenase (ubiquinone)
  misc_feature (340)..(340): n is a, c, t, g, unknown, or other
  misc_feature (383)..(383): n is a, c, t, g, unknown, or other
  misc_feature (576)..(576): n is a, c, t, g, unknown, or other
  misc_feature (706)..(706): n is a, c, t, g, unknown, or other
catagctggagctccccgcggtggcggccgctctagaactagtggatcccccgggctgcaggaattcgcacgagaccattacctagaacatcctaatcgaaaagtcggcgttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtgggtggtgggggccggcgncgcggggctccgggcggcgatcggcctctccgagcacggcttncacaccgcgtgcatcaccaagctcttccccacgcgctcgcacaccgtcggggctcagggaggcataaatgctgcacttggaaacatgagtgaagatgactggaggggggatatgtatgacactgttaagggaagcgatgggctgggtgaccaggattctattcagaatatgtggagagaggaccaaaagctgntatagaggctggaaactatggaccaccattttcaagaacggaagaggaaaagatataccacggggcttttggagggcaaaacttaaaattttggacaaggtggaccagccccaacggtggggcccgggcntggccgacagaacgggacctgctttgctttt

SEQ ID NO: 35352 - DNA, 734 bp, Zea mays
  misc_feature: Ceres CLONE 1414676-F
  misc_feature: Translation starting site: 228
  misc_feature (223)..(223): n is a, c, t, g, unknown, or other
  misc_feature (270)..(270): n is a, c, t, g, unknown, or other
  misc_feature (272)..(272): n is a, c, t, g, unknown, or other
  misc_feature (273)..(273): n is a, c, t, g, unknown, or other
  misc_feature (317)..(317): n is a, c, t, g, unknown, or other
  misc_feature (393)..(393): n is a, c, t, g, unknown, or other
atagctggagctccccgcggtggcggccgctctagaatagtggatcccccgggctgcaggaattcgcacgagaccattacctagaacatcctaatcaaaaacggcggggttgttgtcgcttgtggccagccgccagcaccagcacaaggcgatcgagagtggtgaccaccagtaaactgcaaagtgcaaaccaaacaccacccacgaagaaaagcggagaggnagcaatggcggagccgagccagcagctgcggtcgttcgtggaggtgncnngcggctcccacttcccatccagacctggccttcggggtcttcgnccgggggggggggcaagcgccaagcgcgccgccccgggggggcaatcgggacttcgcgctcgaacttcgcggcgtngccgaaggggggttctttcaagggcccggggttctccgttccccgggtttccacaagagacgctcaacattgtcttggggatggccccgcccgcgtgggaagaagccccccccacgctaaaaaaaattctatcagccgaaaaagcccgttttggggggaaaacaaaaacccgaggaacaaggtggcttgaccaaaggatgagaataaaaaggggtctaacaactaagggtgggaggttaaaccggatcttttttttgttttggggaacaaggcaaggaattggggggatccttcttccagggggcgcaaaacccccggcaaatccaatttggtttttattt

SEQ ID NO: 35353 - DNA, 737 bp, Zea mays
  misc_feature: Ceres CLONE 1414680-F
  misc_feature: Encodes the peptide sequence at SEQ ID NO. 35354
  misc_feature (415)..(415): n is a, c, t, g, unknown, or other
  misc_feature (446)..(446): n is a, c, t, g, unknown, or other
  misc_feature (543)..(543): n is a, c, t, g, unknown, or other
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaactacacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctggcggaaggaggtcttcctcgtcgagaccatggacaacgcctccagnctccagggagtccatggcgcaccctcaaggncgtctacttcctccgaccctccgctaacaacgtccagaaagctccgcaggcacctcgccatgccgcgcttcgccgagtaccacctattcttctcagnnatattgaaggtcccgcagattcaatacttgctgactcggatgaacagggagttgtgcagcaaagtcaggagtctatgctgatttttgtgccatgacccataccattcactctcaaatacaaataacacatgtatatgctccaacagtgtcgccctcctggatgcagggttctgtgatcgagcgttgaggcttt

SEQ ID NO: 35354 - protein, 133 aa, Zea mays
  misc_feature: Ceres CLONE 1414680-F
  misc_feature (60)..(60): Xaa is any aa, unknown, or other
  misc_feature (70)..(70): Xaa is any aa, unknown, or other
  misc_feature (102)..(102): Xaa is any aa, unknown, or other
  misc_feature (103)..(103): Xaa is any aa, unknown, or other
MVLITLVRDYIDRMLHDIPGMKVLVLDPQTVGMVSVVYSQSDLLAEGGLPRRDHGQRLQXPGSPWRTLKXVYFLRPSANNVQKAPQAPRHAALRRVPPILLXXIEGPADSILADSDEQGVVQQSQESMLIFVP

SEQ ID NO: 35355 - DNA, 710 bp, Zea mays
  misc_feature: Ceres CLONE 1414682-F
  misc_feature: Encodes the peptide sequence at SEQ ID NO. 35356
cgctctattctagtggatcccccgggctgcaggaattcgcacgagaccattacctagaacatcctaatcgaaaaaaggaaacgtcacgtcaccaccacacacctcttcggctcttcctcttctcctccgtatagcggcgggcctccgtcgccccccttccaccccgttttgccgccccgcaggccacagcccaaaatcctcctcgtcgctggtgccctctccgcggactcctccgccagacatggccgccgctgggcccgggctctactccgacatcgtgaagaaagcaagaggtctcctgtacaaggactaccacactgaccggaagttcacgctcaccacttacgccgccaacggagctttcaaggcgcgtgtcaccatggacatgaagcaccgcgtcgtccgcgccatgatcgcgggtagcatgaaaaacggtgatggcccacccgtgcatgcccaggataagaccgaatccggccattactgctgcaaagacaaggaaagatgatcctatctttaaaaaatccagcgccagctgacacacaacaatgtgactggggatgtgaaagaaacttcaaaaatcaaagtgacaactaccatcacagttcccgagggtagccacacccggccctggaggcatttttaaggaattccttttcccgaaaagaaaatcggcaaggggtgaactcccgttacttgcaccaccatgg

SEQ ID NO: 35356 - protein, 88 aa, Zea mays
  misc_feature: Ceres CLONE 1414682-F
MAAAGPGLYSDIVKKARGLLYKDYHTDRKFTLTTYAANGAFKARVTMDMKHRVVRAMIAGSMKNGDGPPVHAQDKTESGHYCCKDKER

SEQ ID NO: 35357 - DNA, 773 bp, Zea mays
  misc_feature: Ceres CLONE 1414684-F
ggagctccccgcggtggcggccgctctttactagtggatcccccgggctgcaggaattcgcacgagaccattacctagaacatcctaatcgaaaaagtgatgatctcatcatcaccctctatctccatcacaataataagttgtggacagtacgacgacacaaaattcaggcgactctcccaccattgctgctgacgaagtaccgaattgtcttctttctcccccctaccttggctggctggctctctagatcgaatcacgggtcaggcgctcccctgaccaaggtcatgagccactacaccatggatgcagccatcaactacgccgcgatgccacccacgtcgccgctgcaaatccccctcccgtaactccctccgcctcctcctccgacggtaccgttaccgccgttggttgttgccggcgccaacggaaggggaaggcctctgaacggggattcccaaaacggtaaacaccccagggggccttccacacaccccggaatttgggggggtttctttttgtgaccccgggtcggggtgacactttttcaggaggtctcccggccccccccggggccgggggtaaccacggaaaaaggaaaggggggcaacaataaacaattacctctctagggcgtcaggcctaggatcgtacaactctctcgaggcgggataaaaaaaaccctattttacaggccccgaagtgggccccccaccccggctaagagaccctcggaaaaccactcatcagactcctctttcacatgctaaagt

SEQ ID NO: 35358 - DNA, 683 bp, Zea mays
  misc_feature: Ceres CLONE 1414685-F
  misc_feature: Encodes the peptide sequence at SEQ ID NO. 35359
ggagctccccgcggtggcggccgctctataatagtggatcccccgggctgcaggaattcgcacgagaccattacctagaacatcctaatcaaaaaaagttgacggccaccccgtccacagccgtgataaactcttcctcagatcccgccaggtacgatggctctctccccttcccctccgcccaacgtcgccgtcgccgccgccctacccctcctcctgctgctcgtctgcgccagcagcattgccgcgcagccgctggcgtcatcacatgccaaggcgctcctccgggtgcgccgactggtgtgatacccgccggggctcgagccgctgggcggggtgccagagccctgcgcgctgccgcgcgctgcggtcctcgtagtcgcctgagagggatggcaggtcacggggctctcagtcctgggagaccgcgaaccggacgcgggctggcgcgcctctttgctccccaacttctcctccgaggggcgtgtccccgcgatcctcaggttcccgagtgttcgcgtgtttctttgtcgaaatgctccgaaaactggggccaggatcgagggaatccaggttctttaggggcgaggaaaaatcaatttggaagaagctccttttgcccaattaggaacaaagaaagaggtttacatccaagagggttggcccttaaaaattgtcctagg

SEQ ID NO: 35359 - protein, 49 aa, Zea mays
  misc_feature: Ceres CLONE 1414685-F
MALSPSPPPNVAVAAALPLLLLLVCASSIAAQPLASSHAKALLRVRRLV

SEQ ID NO: 35360 - DNA, 776 bp, Zea mays
  misc_feature: Ceres CLONE 1414689-F
  misc_feature: Encodes the peptide sequence at SEQ ID NO. 35361
  misc_feature (236)..(236): n is a, c, t, g, unknown, or other
  misc_feature (269)..(269): n is a, c, t, g, unknown, or other
  misc_feature (316)..(316): n is a, c, t, g, unknown, or other
  misc_feature (317)..(317): n is a, c, t, g, unknown, or other
  misc_feature (342)..(342): n is a, c, t, g, unknown, or other
  misc_feature (345)..(345): n is a, c, t, g, unknown, or other
  misc_feature (435)..(435): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaacacgcacaccgcgacccagtccagagccagtacgtgcgaagcagcacgcacgctgctggtccgcgtacgcgagacgacggtcaggtcggccggtgcttttcagtttggaataatgacggcgacgacgacgacngccgccggcggcggcaaggtgcagccgcgcggnctgcccgcggcgctgtccctgctgctgctcctggtgttggcagcggnngctgggcggtggcgccgaggcgcanagnacgtgcgcggggcagctggcgcgggctggccccctgcttgcgctacagcggccaccctgggccgggggcaggttccgccggcgcccgggnccggagtgctgctccgcgcttgggggccggggtctggggactgcggcccggcggaacgttcggccatcctccacaggcctgccgggcaaggtggggcctcccggccgggcaggttgggccggtatggagttggatgattacccagtggcaatgcatggggacaaaagggaaggggaaccccacaacgctgaaattataagggggcccccgggggtcaaggcccaccccggggtccctatttccgncattggggaagggaattgggtaaggaaacccctgtgagggtccgcggggcccctttggcgatttttgtacccccccaccgggcctggggggtgtgt

SEQ ID NO: 35361 - protein, 118 aa, Zea mays
  misc_feature: Ceres CLONE 1414689-F
  misc_feature (34)..(34): Xaa is any aa, unknown, or other
  misc_feature (43)..(43): Xaa is any aa, unknown, or other
  misc_feature (44)..(44): Xaa is any aa, unknown, or other
  misc_feature (74)..(74): Xaa is any aa, unknown, or other
MTATTTTAAGGGKVQPRGLPAALSLLLLLVLAAXAGRWRRGAXXVRGAAGAGWPPACATAATLGRGQVPPAPGXGVLLRAWGPGSGDCGPAERSAILHRPAGQGGASRPGRLGRYGVG

SEQ ID NO: 35362 - DNA, 736 bp, Zea mays
  misc_feature: Ceres CLONE 1414692-F
  misc_feature: Encodes the peptide sequence at SEQ ID NO. 35363
  misc_feature (534)..(534): n is a, c, t, g, unknown, or other
  misc_feature (535)..(535): n is a, c, t, g, unknown, or other
  misc_feature (545)..(545): n is a, c, t, g, unknown, or other
  misc_feature (560)..(560): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacggacacggcgcggtctcaccgtggagcgtgctaggcggggcggcggctgtgctgctcctgtggttggcgtcgcaggtgctggagtggggcctggtgggcgccccggcgcgtgaacccgtgcgctgagggcgcagggcctgaggggcacccggtaccgcctcctctgcggcgccctcatcgaggagcagcgtctccgcgcggcgnncctggcaggnccgtccccccgtggnatcggcacacgacttcgtccctcgcgtcgcgcctttccttcaccgcgtcctccaagagcacgcaaagtctcgnttttaacttgggtttgggcccgaccccaagagttctaatcaccgatccgagttttggccggggaaatgctgccccaaataggtggggcgaacttccgggaagt

SEQ ID NO: 35363 - protein, 43 aa, Zea mays
  misc_feature: Ceres CLONE 1414692-F
MDGHGAVSPWSVLGGAAAVLLLWLASQVLEWGLVGAPAREPVR

SEQ ID NO: 35364 - DNA, 743 bp, Zea mays
  misc_feature: Ceres CLONE 1414695-F
  misc_feature: Encodes the peptide sequence at SEQ ID NO. 35365
  misc_feature (544)..(544): n is a, c, t, g, unknown, or other
  misc_feature (554)..(554): n is a, c, t, g, unknown, or other
  misc_feature (605)..(605): n is a, c, t, g, unknown, or other
  misc_feature (606)..(606): n is a, c, t, g, unknown, or other
aaagctggagctccccgcggtggcggccgctctagaactagtggatcccccgggctgcaggaattcgcacgagaccattacctagaacatcctaatcgaaaatcaagccaacagcttccgaaaagtttccgaaagctccttcagatctgttggttaatggatacactcatcctgtacctatgtctactgctggctggccaaccaatgctagtttagtgcctgttcagagcactggatcaatgactgcaactggttggccacccaatggtgggtcaaatgcttttccaagtactgcatctctatcagctgctggtaattacaacattaaccagtcgcttcccaggtcttccgttggttgggctgtcaatggtgagcaaagtgttattcctagcattgctccaagatttgaactcgtgcagcctgttgaagagcctgtttccagctggacaagcagtggtgcacagcatgttggtactcagcacaagcacacaggtttaattttcccagatggtatgtctgaaccacttgtatctgcatcaatggntccaacgttncagtagcactgattattcgaaatttctcagtgaacaagaaatgcttctagnngaatggactgaatactgtcaactatactggaaatggctatttaaagcaaaactgcaccctaaaaatggatggtttacaggccaagggggaattcatctccaaacctattgggaacgtgggggacccatggcaaactc

SEQ ID NO: 35365 - protein, 126 aa, Zea mays
  misc_feature: Ceres CLONE 1414695-F
  misc_feature (122)..(122): Xaa is any aa, unknown, or other
  misc_feature (125)..(125): Xaa is any aa, unknown, or other
MSTAGWPTNASLVPVQSTGSMTATGWPPNGGSNAFPSTASLSAAGNYNINQSLPRSSVGWAVNGEQSVIPSIAPRFELVQPVEEPVSSWTSSGAQHVGTQHKHTGLIFPDGMSEPLVSASMXPTXQ

SEQ ID NO: 35366 - DNA, 738 bp, Zea mays
  misc_feature: Ceres CLONE 1414697-F
  misc_feature: Encodes the peptide sequence at SEQ ID NO. 35367
  misc_feature (547)..(547): n is a, c, t, g, unknown, or other
  misc_feature (552)..(552): n is a, c, t, g, unknown, or other
  misc_feature (592)..(592): n is a, c, t, g, unknown, or other
  misc_feature (593)..(593): n is a, c, t, g, unknown, or other
  misc_feature (615)..(615): n is a, c, t, g, unknown, or other
  misc_feature (701)..(701): n is a, c, t, g, unknown, or other
  misc_feature (709)..(709): n is a, c, t, g, unknown, or other
aaagctggagctcaccgcggtggcggccgctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaaaaagggcggcggtggaggcatgcccggcgatgacgggctggatgactttgggttggaggacgaggacgcggacccttcggctgaggcgaggaagaggaagggctcgtcgtcgctgagggacctcgcgaggggcggngcggncagggagaaaaaggctaagaaatgcggaggaggacgacgnnagggggaggcaactgggatggngaggaataagcgccatcaggaagaaggacccagggggaaggatgaccagaaggaggggaaagagaaccaggagcccgggaaaccangggggggncgagccaaggaagccaaaaaggggaaaaa

SEQ ID NO: 35367 - protein, 176 aa, Zea mays
  misc_feature: Ceres CLONE 1414697-F
  misc_feature (115)..(115): Xaa is any aa, unknown, or other
  misc_feature (129)..(129): Xaa is any aa, unknown, or other
  misc_feature (136)..(136): Xaa is any aa, unknown, or other
  misc_feature (165)..(165): Xaa is any aa, unknown, or other
MGDNYDDEGEPIVNLDEREPSPEHQPYEDLDDDLDGGGDWTRDRSPTPVHGDDGGAGSSSKPRKRLLKKGGGGGMPGDDGLDDFGLEDEDADPSAEARKRKGSSSLRDLARGGAXREKKAKKCGGGRRXGEATGMXRNKRHQEEGPRGKDDQKEGKENQEPGKPXGGRAKEAKKGK

SEQ ID NO: 35368 - DNA, 736 bp, Zea mays
  misc_feature: Ceres CLONE 1414700-F
  misc_feature: Encodes the peptide sequence at SEQ ID NO. 35369
  misc_feature (597)..(597): n is a, c, t, g, unknown, or other
  misc_feature (635)..(635): n is a, c, t, g, unknown, or other
  misc_feature (636)..(636): n is a, c, t, g, unknown, or other
  misc_feature (671)..(671): n is a, c, t, g, unknown, or other
  misc_feature (705)..(705): n is a, c, t, g, unknown, or other
aagctggagctccccgcggtggcggccgctctagaactagtggatcccccgggctgcaggaattcgcacgagaccattacctagaacatcctaatcgaaaagaagcgaacttgagccagagagagaatctcgcaccgcagcaggaggggaccgagagagaagcgaactcgagaaagggattcaaggaggctgttgccgatggccatggcggcgcggctgctgcgagcaaccgaggtggcatctcgatttctatctgcttcccatggtttcgtccagcgagctgcatacacagctggtgggatagtcgatgttggccaaccaacaccccagtctcatccagagttattagctgatggagagatcacaccaggcatcacaaacgaggaatacatctctagaagaaaaaaacttttagaggtgctaccagagaagagcttggccattattgcttctgctgatcagcagatgatgactgatgtagtgccatatccattcagacagaatggtgattacctgtatattacaggttgtacacaacccggtggagtagcagttttgagtgaagaaacagggttctgcatgttcatgccagatacnaataaggaggatttagtttggcaaggtgaaactgctgnnagtgaggctgctgtggatttctttaagcagataangcatttccactagtcagatgcaaaagatcttccntgactgatgagcattccaaaagggtgtatcc

SEQ ID NO: 35369 - protein, 161 aa, Zea mays
  misc_feature: Ceres CLONE 1414700-F
  misc_feature (59)..(162): Pfam Name: AMP_N Pfam Description: Aminopeptidase P, N-terminal domain
  misc_feature (146)..(146): Xaa is any aa, unknown, or other
  misc_feature (158)..(158): Xaa is any aa, unknown, or other
MAMAARLLRATEVASRFLSASHGFVQRAAYTAGGIVDVGQPTPQSHPELLADGEITPGITNEEYISRRKKLLEVLPEKSLAIIASADQQMMTDVVPYPFRQNGDYLYITGCTQPGGVAVLSEETGFCMFMPDTNKEDLVWQGETAXSEAAVDFFKQIXHFH

SEQ ID NO: 35370 - DNA, 749 bp, Zea mays
  misc_feature: Ceres CLONE 1414702-F
  misc_feature: Encodes the peptide sequence at SEQ ID NO. 35371
  misc_feature (536)..(536): n is a, c, t, g, unknown, or other
  misc_feature (682)..(682): n is a, c, t, g, unknown, or other
  misc_feature (724)..(724): n is a, c, t, g, unknown, or other
aaagctggagctccccgcggtggcggccgctctagaactagtggatcccccgggctgcaggaattcgcacgagaccattacctagaacatcctaatcgaaaaactggagccctataggctatagccatcaccacactcgcctccctctctccctcccacactccaccacccgcgccgccgcctcctactccgccccggcccctctgatccggaccgagcgccggccatggcgctcgccttcgacgagttcgggcgccccttcatcatcctgcgggagcaggagaagaagacgcgccttagggggctcgacgcgcagaaggccaacatcgcctcggccaaggccgtcgcgcggatcctccgcacgtcgcttggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccngggtggtagtcatggcaggggctcttctcgagcaggccgagaagcttctggagcgtggtattcaccccattagggtggctgaaggctatgagatggcgtcaaaggtagctttttgacaccctagacatatctcccgaaagtttgangtcagtgcagacaacatttgacccctggtccagaactgcatngacactctatcctcaaaggatgtaa

SEQ ID NO: 35371 - protein, 141 aa, Zea mays
  misc_feature: Ceres CLONE 1414702-F
  misc_feature (104)..(104): Xaa is any aa, unknown, or other
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTXVVVMAGALLEQAEKLLERGIHPIRVAEGYEMASKVAF

SEQ ID NO: 35372 - DNA, 684 bp, Zea mays
  misc_feature: Ceres CLONE 1414703-F
  misc_feature (386)..(386): n is a, c, t, g, unknown, or other
  misc_feature (412)..(412): n is a, c, t, g, unknown, or other
aaagctggagctccccgcggtggcggccgctctagaactagtggatcccccgggctgcaggaattcgcacgagaccattacctagaacaacctaatcgaaaattacctagaaattagggatgctaaacttgttgaagtgaagcatgcacagttagaacatgagatttcttgtcttgatttgaacccaattggagagcatctagagtatagttccctagctgctgttgggatgtggacagatataagtgttagaatattttcacttccagatcttgtattaataaggaaagaaaatttgggtggagaaattgttcctcggtctgttctgctgtgcaccttggagggggtttcgtatttactttgtgctcttggggatggtaatctgntcagttttctgctgaaatgcagcacnagtgaactgactgatagaaaaaaggttaccctcgggacccaacaatcagccctcgtacatttctcatcaagggtaccaccccacgtgtttgcttcatcagatagggccaactgtcatctatagcagcaataaggaacttcccctatagcaatgtaaattttgaaagaagttaatcatatggggccctttcaataaagcccctttttccaaaaagttttgcgaattgctaaagagggggagcttccaatggaacaattgttgattccacaaaa

SEQ ID NO: 35373 - DNA, 662 bp, Zea mays
  misc_feature: Ceres CLONE 1414704-F
  misc_feature: Encodes the peptide sequence at SEQ ID NO. 35374
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
atagctggagctccccgcggtggcggccgctctagaactagtggatcccccgggctgcaggaattcgcacgagaccattaccctagaacatcctaatcaaaaagacaaaatttcccactccactcgaattaaaaccctagcggcaaaaccttcgctctgcgccgccgtcgcctgctcccgtcccgccaccacatccgcccaggagctcgccgtccggggaggctgctccgagggaaccccccggcttggttttttttcccgggccggcacttccccctcgcgccgaagatttggcgatcccgggggggggccgaaaacccgggggggcaaaaaaaagggggttttccccaaagggggggtcttccaggggccttttgggggccccggggaagggnnnggtccccccccccccaggggggggccctccaggggggatagggggcgggcaaaaaaaaaaaagggggggaaaacccccccccttcgggggggggaaaaataccccgcacccctggtggttttttacaaaaaaggggggggccccccccccccccaaataggggggggggggggggcgccccccccccccgccaaaaaaaaatatttttttcgccccccacccagggagggggggcgcccgcggcgcttctccacagggggaagag

SEQ ID NO: 35374 - protein, 31 aa, Zea mays
  misc_feature: Ceres CLONE 1414704-F
IAGAPRGGGRSRTSGSPGLQEFARDHYPRTS

SEQ ID NO: 35375 - DNA, 725 bp, Zea mays
  misc_feature: Ceres CLONE 1414709-F
  misc_feature: Encodes the peptide sequence at SEQ ID NO. 35376
  misc_feature (663)..(663): n is a, c, t, g, unknown, or other
caaagctggagctccccgcggtggcggccgctctagaactagtggatcccccgggctgcaggaattcgcacgagaccattacctagaacatcctaatcgaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcggcgtgaccaccaagcataacgatgacgaggagtacgtgtggacatcccaggngggccggccgctcactgttactcgtgacacgtctggggagcagctttggcaggggaactaaa

SEQ ID NO: 35376 - protein, 173 aa, Zea mays
  misc_feature: Ceres CLONE 1414709-F
  misc_feature (28)..(158): Pfam Name: HATPase_c Pfam Description: Histidine kinase-, DNA gyrase B-, and HSP90-like ATPase
  misc_feature (154)..(154): Xaa is any aa, unknown, or other
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVGVTTKHNDDEEYVWTSQXGRPLTVTRDTSGEQLWQGN

SEQ ID NO: 35377 - DNA, 779 bp, Zea mays
  misc_feature: Ceres CLONE 1414711-F
  misc_feature (340)..(340): n is a, c, t, g, unknown, or other
  misc_feature (351)..(351): n is a, c, t, g, unknown, or other
  misc_feature (374)..(374): n is a, c, t, g, unknown, or other
  misc_feature (409)..(409): n is a, c, t, g, unknown, or other
  misc_feature (427)..(427): n is a, c, t, g, unknown, or other
  misc_feature (429)..(429): n is a, c, t, g, unknown, or other
  misc_feature (434)..(434): n is a, c, t, g, unknown, or other
  misc_feature (435)..(435): n is a, c, t, g, unknown, or other
  misc_feature (438)..(438): n is a, c, t, g, unknown, or other
  misc_feature (446)..(446): n is a, c, t, g, unknown, or other
aaagctggagctccccgcggtggcggccgctctagaactagtggatcccccgggctgcaggaattcgcacgagaccattacctagaacatcctaatcaaaaagacgggtatgctacagtgttggtggcgttcgcagcagtcttgtccgatcatcaatggataccaccaacccagtagtagctgtgacttcgacgagtgatggagcgtagcgcggctggagtggacgtacgcccggcttctcgtcttcgtccggggcgagccgagtccccctccctggctccctcctccttgccgcggcaccctgcatcgcgacgtccgcgaggagacttggcaggcgcgncaatccgcgtngtcttggggagctgctcgtttgntacgcgttgatgctgctaaaaaagatcttcactgnctcgggatttgaacaaangncgtgnntcnaagctggngtggtccgttcatggtgccgaaggaaaggcccggggtattggggaaaatattgaaggttaacaaggaggttggttcccccctcccgaagggatggattcccagttccgaaagggcccgaagccccccaaaaaaaaacttggggaaaaccccccttggtttgtggggaaccaaaaccgggggggggggttatgggaaacccaaatattctccccgggtagggggaaaaaaaaccccttttccggggaattaccccattttttgaaaaaaaaagggaaatattttgggggggtttccccttttttttttggggggccccccactctcccccttgt

SEQ ID NO: 35378 - DNA, 764 bp, Zea mays
  misc_feature: Ceres CLONE 1414719-F
atagctggagctccccgcggtggcggccgctctagaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagtttgtttcttcggcaccgagccatcgcacggccgcccccgcatctcgtcctgctctcaggtccttggcctccgccgttcttcgacaggggcgcgacccggtgcccactccgcgaatccgagtccctcgtgcagctccgtagggtgaaagagatcatccggcggtgagcggtaggaggcgcccgtacaactgagggggcgggaaagggcggccggggcaggccccctctgcacgtggttccgttccgcggggttgtctggggtttgccacccaaaaaagtccaacataacctttgctgcccccgccgaaacgggcctttggggggggttattgtctcgcaaggcccccccctttggggggggggttccggcttttgggccccctagaaaaggataaaggggtgtggccaaaaaacgggaaaaaaaagtgctctttaaaaaaaaaaaaaccccccatttaccacaaaagggggggggtgggtccccacaagatggtggggtgagtaccaaccccccatttcccccc

SEQ ID NO: 35379 - DNA, 684 bp, Zea mays
  misc_feature: Ceres CLONE 1414721-F
  misc_feature (316)..(316): n is a, c, t, g, unknown, or other
  misc_feature (323)..(323): n is a, c, t, g, unknown, or other
  misc_feature (331)..(331): n is a, c, t, g, unknown, or other
  misc_feature (396)..(396): n is a, c, t, g, unknown, or other
  misc_feature (450)..(450): n is a, c, t, g, unknown, or other
aaagctggagctccccgcggtggcggccgctctataactagtggatcccccgggctgcaggaattcgcacgagaccattacctagaacatcctaatcgaaaagttccaaaaagaaaaaagaaaaactcagccgccggccgctgcccctctcggctgcacgacgtccgtgagggcgtgccccctggccccgtcccttgtcgcctgcccgccggtgcccgcacaggctgccagtgccatactgccatccctccgtccggccgtctgcccaggctgcctgcccggcgccctggcctcccggtcgctggctctctgcccnagcgccnagccgcangtcccaccgccccagaccacccgcgaaccagtccgctgcaggctgcaggccaccgtccctccagntcgccggtcagattattaccattcagatccccagctcccgctagacccaatccntcgccactatgggggcagggtgtccctgcagagccaagaaaggccggggtttgaagcccgttttggaacccgggtttatccactcccccctcaaaattcctggacctaaattccggaaggttaatacccccgtcccaattgggttccaaagcctgaaaaaatttggcccccctttggcccccccgggggggggaaaaaaccggggggccaaatggtttttttatattttaaaaa

SEQ ID NO: 35380 - DNA, 772 bp, Zea mays
  misc_feature: Ceres CLONE 1414733-R
  misc_feature (111)..(111): n is a, c, t, g, unknown, or other
  misc_feature (454)..(454): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
aatttctttgttttgtatcgtactttgaatgaataaacagatcttcgggtattggagagaaattgcttaacggaagcaccgattcgtgtattcatagcctgggcgcagccnttgaccggagcgcccgttgcttgcgggtgcagtgtcagcacgtgtaggcgcgtggacgtacgccgcgacactcgaacgcgagcgctgcaggatcatgctgacgccagcttggcctcaggagcccaaagtcttggccattcaaacccccggccccccctttaaaggggcaaaggcccggggtccctgcacccccttgaaccccccttggggaaccctccccgggttaaatcccctggggtcgggaaccccccagggggggggcccccggggaaaaaaaataaagcggcccctctttaaaatttccccccccgcgggggtttgtgaccccccccccacttttttncccggggtgtttccccgggtttttttcccccccccccccgggggggaaaaacccccccccccccccccagaaagcccgggggggcgcacccccttttnnnnggcggcccccacattttgttaaggagggggggtgtttttttccccaaaaaaagaggggggggggggccccccccccccccggggagggggggggcccccccccccgggggggggggtgtttcttccccccccccccccccttttctctttataaaaaacccggggggcggggggggcccccccccccccccccgggggaagaaaaaccaaccccccc

SEQ ID NO: 35381 - DNA, 653 bp, Zea mays
  misc_feature: Ceres CLONE 1414735-F
  misc_feature: Encodes the peptide sequence at SEQ ID NO. 35382
aaagctggagctccccgcggtggcggccgctctagaactagtggatcccccgggctgcaggaattcgcacgagaccattacctagaacatcctaatcaaaaagagggcgcgcattactctgcagcgcggacacgcccggcacggcaagccagccactcttctcgcgtgaagctgccaggacgagagagagagaggaggaggattagcttacccattcttgcggctgggcaaggaaactgctgaagccactagccggctgcctgctctacttcctccgaaccgaacgaggtgcatcgtgaggaagcagcagcagggggggcagtggccgggcgggatgacggtgagggacgccgtggcggcgtcggaggcgcagctggatcaggactcggcggcggcggcggcgcccgtgctgctgagcccgctcagcgagacgctgtggcgcgacagggcggcagagatcggcgggcggggtcctcgtcggggacgtgtcggcgcgcctggagtgccgcgacctcaccgagaccgtcgcggttcggctccgggtgacccgcagggccgggctgcagggccttcacggggaacgcgcagcccggaacaaaaaccggctgtgggcccgatccggttccggaaaatccccgttggtcgaacaaaat

SEQ ID NO: 35382 - protein, 106 aa, Zea mays
  misc_feature: Ceres CLONE 1414735-F
MTVRDAVAASEAQLDQDSAAAAAPVLLSPLSETLWRDRAAEIGGRGPRRGRVGAPGVPRPHRDRRGSAPGDPQGRAAGPSRGTRSPEQKPAVGPIRFRKIPVGRTK

SEQ ID NO: 35383 - DNA, 750 bp, Zea mays
  misc_feature: Ceres CLONE 1414736-F
  misc_feature: Encodes the peptide sequence at SEQ ID NO. 35384
  misc_feature (628)..(628): n is a, c, t, g, unknown, or other
  misc_feature (654)..(654): n is a, c, t, g, unknown, or other
  misc_feature (735)..(735): n is a, c, t, g, unknown, or other
aaagctggagctccccgcggtggcggccgctctagaactagtggatcccccgggctgcaggaattcgcacgagaccattacctagaacatcctaatcgaaaagagattcgccgtctcaccccttccctgcctgctccctcgtctaagaaaagcgggcagagcagagacggcggcggcaggccatcgcggactcccgctcaccctcgtctgccaccgcctcccaggtcaggggccgacggcgacgggtggggaggggcggcagaggtagtccgaggggaggctgtggagcggagggcggagagaggccacgccgtccggagtctccagttccgtcgccacagcttcctgccgcgcctgggccgaggtaaacgagagggatcgaggaagaagtatcccccggagccccttcccccgaacccgaaggctccggaatggcgcactgggttagcgacagtgatggcagtgacaactttgaatgggatagtgatggcaatggggaggagccagcgaacttcaatgctgctggtgccggttcatcagctctgagatcaacgaacactgatgctccaggtccatcaacacgggttgctaatggcaatggggaagctgggccatctgcctccttggntcaaaagatatggacatgggtttcancggagagattgttcggaaagccatgaaggacaatggggataatgaagcagattcattagttgagctccttcttacttacangaactaggcaatgac

SEQ ID NO: 35384 - protein, 82 aa, Zea mays
  misc_feature: Ceres CLONE 1414736-F
  misc_feature (66)..(66): Xaa is any aa, unknown, or other
  misc_feature (75)..(75): Xaa is any aa, unknown, or other
MAHWVSDSDGSDNFEWDSDGNGEEPANFNAAGAGSSALRSTNTDAPGPSTRVANGNGEAGPSASLXQKIWTWVSXERLFGKP

SEQ ID NO: 35385 - DNA, 690 bp, Zea mays
  misc_feature: Ceres CLONE 1414739-F
  misc_feature: Encodes the peptide sequence at SEQ ID NO. 35386
  misc_feature (426)..(426): n is a, c, t, g, unknown, or other
aaagctggagctccccgcggtggcggccgctctagaactagtggatcccccgggctgcaggaattcgcacgagaccattacctagaacatcctaatcgaaaaatttcccagctccaggttccagaacacagctccgatcccattcccatccaattggttcttggaatcgcattccacgacataaatagcatctgcactgcatcccatatgtttctcagcgagcatgctgcaggccatttcttcccaccagtgtgccgttgtcgctgaagcgccagtagtgtgattcgttcataaaggtgtgagatcatccacacaacaactagctcgaagctagtagctgctgccatggtagtagcactgaggctgggacatttgtgctgcgcggttgtgcttgcgttgtccatctcttggtgcagaggacaaggnagaggaggaggaggtgctgctggtgcaggtggtgctggtgcagcagggggcgcggaaagtggtgctgtggttccagggacacaggatgccatccagatcgtgtcacaggctgctctctgctttgacatagacaggtgataaacgggtgcctccaagcaatgggcatcaatgtcaacagcaacggcggcaacagcaacggtggcagtagcaatggcaagtggcggccgcagcagtggaagcggttgcagtaaccattgccagtgg

SEQ ID NO: 35386 - protein, 72 aa, Zea mays
  misc_feature: Ceres CLONE 1414739-F
MVVALRLGHLCCAVVLALSISWCRGQGRGGGGAAGAGGAGAAGGAESGAVVPGTQDAIQIVSQAALCFDIDR

SEQ ID NO: 35387 - DNA, 714 bp, Zea mays
  misc_feature: Ceres CLONE 1414742-F
  misc_feature: Encodes the peptide sequence at SEQ ID NO. 35388
  misc_feature (714)..(714): n is a, c, t, g, unknown, or other
agagctggagctccccgcggtggcggccgctctataactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgagccggctcttcctcgcggcggcggcgctgctgatggctgtgcttctgctcgtcgcggggccggtggcggcgcaggacgcggcggtggagggcgtggccccgcctgcggaggagatcgcggcgaacgcgagggccaaggaggcggtggttctggccgccgagctagtgcagctcagggcgaatatctccgcgttagagtctccgcattgcatagcagaaccctggagttccagaccaagaatgatggaatccaaaacactggatattgattgtcaaggaaaaaggccccagaaaaattggctcctatgcaaaaaggaaacccaaagggtccttttaccttgcaaaagggaccagggaaaggaaagggcccatggcccgggggttattgggggttccagaagccccaaccgggaaatctccaagaagggattttccccccaccaaaaatttttaaaaacacccaccttttgaaggggtagagagtcgggan

SEQ ID NO: 35388 - protein, 160 aa, Zea mays
  misc_feature: Ceres CLONE 1414742-F
MWIASRLFLAAAALLMAVLLLVAGPVAAQDAAVEGVAPPAEEIAANARAKEAVVLAAELVQLRANISALESPHCIAEPWSSRPRMMESKTLDIDCQGKRPQKNWLLCKKETQRVLLPCKRDQGKERAHGPGVIGGSRSPNREISKKGFSPHQKFLKTPTF

SEQ ID NO: 35389 - DNA, 676 bp, Zea mays
  misc_feature: Ceres CLONE 1414746-F
  misc_feature: Encodes the peptide sequence at SEQ ID NO. 35390
aaagctggagctccccgcggtggcggccgctctataactagtggatcccccgggctgcaggaattcgcacgagaccattacctagaacatcctaatcgaaaaaatcgaaaccaacagtgaatcagccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggaggcctgcagcagcggcgggccctgtaccagccccgcctcccgccatgcctccagggaccgacggtaagggcggagtacggtgacgcgaccacaaccatcgatcccacctgtgcccaagccgtcgcgcaggccttcccgcacacctttggccagccgctcgtcagcttcgtcgcgccggccgccggcgccggcgccgttgaggagcgccacccgatcagggtgggcgtggtgttctctgggaggcagtcgccgggagggcacaacgtcgtctggggcctccatgacgcacttaaagcctacaatcctcagagcttgctctacggattcgtcggtgg

SEQ ID NO: 35390 - protein, 124 aa, Zea mays
  misc_feature: Ceres CLONE 1414746-F
  misc_feature: SWISSPROT Homolog: EC 2.7.1.90 Diphosphate--fructose-6-phosphate 1-phosphotransferase
MNADFGAPKELAGGLQQRRALYQPRLPPCLQGPTVRAEYGDATTTIDPTCAQAVAQAFPHTFGQPLVSFVAPAAGAGAVEERHPIRVGVVFSGRQSPGGHNVVWGLHDALKAYNPQSLLYGFVG

SEQ ID NO: 35391 - DNA, 660 bp, Zea mays
  misc_feature: Ceres CLONE 1414747-F
  misc_feature: Encodes the peptide sequence at SEQ ID NO. 35392
  misc_feature (610)..(610): n is a, c, t, g, unknown, or other
aagctggagctccccgcggtggcggccgctctagaactagtggatcccccgggctgcaggaattcgcacgagaccattacctagaacatcctaatcgaaaagccttgaccgacgtgactacggtacggcccccaaacccggaacggcagcgaaacgacagccatgcttctccagccgatccccaccgccaccctcgccgctcgaccgagatcaagcgaagcttccttcccctttcgttgccaccgccgccgccgcgtgctcctcccagtccgcgccgacttgaccccgatctctctctcggcctccgccccctcgcggccggccaagccggccgtttgcaccgccgacgagctccattacgcctccgtcgacggtgccgggtggcgactcgcgctctggcggtacaggccaccgcgcaatgctcccgtcaggaatcacccgctgatgctgctgtcgggagtcggaacgaacgccgtcgaattcaacctctcaccgggggcttcgttggccgtcacatgtctaaccaaggattggaaacatggataagtgaaaaaaaaagggctggcctgagaatgcgggaaaaagaggatccaaccccatcgggctccancccttttgggggaggcccccagggggattcaacccctttaaaaaaaactt

SEQ ID NO: 35392 - protein, 127 aa, Zea mays
  misc_feature: Ceres CLONE 1414747-F
MLLQPIPTATLAARPRSSEASFPFRCHRRRRVLLPVRADLTPISLSASAPSRPAKPAVCTADELHYASVDGAGWRLALWRYRPPRNAPVRNHPLMLLSGVGTNAVEFNLSPGASLAVTCLTKDWKHG

SEQ ID NO: 35393 - DNA, 681 bp, Zea mays
  misc_feature: Ceres CLONE 1414752-F
  misc_feature: Encodes the peptide sequence at SEQ ID NO. 35394
aaagctggagctccccgcggtggcggccgctctataactagtggatcccccgggctgcaggaattcgcacgagaccattacctagaacatcctaatcgaaaaacccgacccgcctccaactccaagccaagccgccatggagggtccgcccgcgacgaccgccacgactcaccaccgcgcgctcctcccgcccacgcgcaccgacgacgccgctacgcactccgcggtccggctcccgctccgcgcgcatccccacgcccacgcccagcgcgcgcgcctcagcgccgccgctgccccggaccccgcggcggcgacggcctccctcgaggcctccgccgcggggaaggctaccgagcacgtggccgaaaacctcggcgccgcgggggttgccctgcagcgagaattccccaacgtcgactgatcctacggtctctcccccgaggacctacgtgccaagatctcgctctgcgacgcgctcatcgtcacgtccaggaccgaagtcggccgcgacatcttccaggcgtccgcgggcagggtccgcgtcgtcggacgcgccggcgtcggcatccacaacgacaaccttgccaccgacaccgaggacggatgccgcgtcgtcaacgagaccagtgacaacaccgtagccgccgacgagcatggtatcgcgctgctcaccgccatggg

SEQ ID NO: 35394 - protein, 94 aa, Zea mays
  misc_feature: Ceres CLONE 1414752-F
MEGPPATTATTHHRALLPPTRTDDAATHSAVRLPLRAHPHAHAQRARLSAAAAPDPAAATASLEASAAGKATEHVAENLGAAGVALQREFPNVD

SEQ ID NO: 35395 - DNA, 823 bp, Zea mays
  misc_feature: Ceres CLONE 1414754-F
  misc_feature: Translation starting site: 730
  misc_feature (674)..(674): n is a, c, t, g, unknown, or other
  misc_feature (776)..(776): n is a, c, t, g, unknown, or other
aagctggagctccccgcggtggcggccgctctagaactagtggatcccccgggctgctgaattcgcacgagaccattacctagaacatcctaatcgaaaaaaccaaaacaatcaataaactagcagaagtcagcgcctccctcctccgcccgtttcctcaagcgacaagaacccaaccactccgcgtcgtcgtctgctgccaatggaggaggagcgctgcttcaacaactgggatctggacgccgtcgtgcgcttgggctgccgccgcctcctctccccgtcgccgcagcccgacccgttcgcttcgtttctcccgccgccgccgcagaaggagaaagcccgtggcgccagcgccggctaaagagccagagccacataccgcgtggcgcttccctgacctttggtgctggcgccggccaagaccgggaagagctcctcagggccctgttagccgaccagccctcccctgaatcagtcctctgccaacgcccagcggcaacctccaacgcccaccgccaacgggcaacgccctcccccaaccatcaaaaaaaagcacacatctaacagcccgaactgtgaaagggcctgggaacacggcctcccaccccataggtgacgcccccgctcccggtctaggggtcccaccccaatcgtttcgcgaaaagtgggccccnttgggtcggcccccaagcatcccaataaaaaaggaaaaaaccccggcagaaccaaatgcggtatctggccaccattacccgcgcggaacggttctacgttcncccggaacactggtggcctcttgggctccacaattaccgcgataaaa

SEQ ID NO: 35396 - DNA, 629 bp, Zea mays
  misc_feature: Ceres CLONE 1414757-F
  misc_feature: Encodes the peptide sequence at SEQ ID NO. 35397
  misc_feature (494)..(494): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaactcactatatactcactcctgctgttttccgtccatccgcccaccggttcgcagcccgcgcctcaaaaccctagccccgggcggatcgcggggcgcctccgcggtgccagcgacgcggctcgtttgatccgattgttggtcgagccccgccctcgctgccgcgcttcgctccggctgtgcagcggcgtgagcaccgagcacactcgcgaatggggaactgctggggtgcgcggatcaaggatgggagccctcaccctggcgcctcaggaatgttctcaaagagtagtggcaaggatgggagtaggcttagcggctgtagtagtcgagcctcttcagcttctatgccaccaagtgcgaagactgaatgtgaaatccctgcatccgccatggtnagatctttcacttcataatctcanggcagccacaggaatttccgtcctgataatggtctaggggaaggagggtttggatctgtctattagggatgatagatgagaccccttattcccttgcaggacctgcactgg

SEQ ID NO: 35397 - protein, 66 aa, Zea mays
  misc_feature: Ceres CLONE 1414757-F
MGNCWGARIKDGSPHPGASGMFSKSSGKDGSRLSGCSSRASSASMPPSAKTECEIPASAMVRSFTS

SEQ ID NO: 35398 - DNA, 890 bp, Zea mays
  misc_feature: Ceres CLONE 1414760-F
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
nttttcccccccnnnaaacccccccccccccaacccnnncccgggattggtaacaaagctggagctccccgcggtggcggccgctctagaactagtggatcccccgggctgcaggaattcgcacgagaccattacctagaacatcctaatcgaaaaaaagcaccacgcacgatcgccttcgccaaccgcgccgctctctctctctttctctctcgcacgagccgcgccggcgccgccaccacgcgcgcgggcagacagacaccacagccgcacccaccgatggtaggaataggaatggtggcacccgggtatagcgccagcaccccgtcccctgccgtcccccccccgcgagccccctcgcacctggccggccatacgggggcggtggattagggggaatgggatgaaccaccccccctatcggatggcctggtttgccccttaacgtaattatggcccttatgagcggccccaacattgcaacccatcgaggcgccgcccagacacccccccggtctatccccgccttcagcatttagcgggaggcaacgccgcctgggcgcttgcggccccccccccactaaagaggcactttggaaaaaaaccccctctctacttctttctcccctttcaccagacctttatacaacgcccgcttccgactccccaaattccaacaaacgccccctatactacaaattccgaccacccttaccctcccctcgacccgcgaacccccccattggggttcaacgcccccgcaggacgttttgctccgcgggggcgatgtgcaaccccgcaaaccacgcgggcgggcgcccgcgcaggcgcccgccccgcgaacgcggggcgccttcgcctcccgcaagcggaacacggggggcgcctcg

SEQ ID NO: 35399 - DNA, 719 bp, Zea mays
  misc_feature: Ceres CLONE 1414762-F
  misc_feature: Encodes the peptide sequence at SEQ ID NO. 35400
  misc_feature (438)..(438): n is a, c, t, g, unknown, or other
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcanggncgtctacttcctcccgaccctcgctaacacgttcagaagctccgcaggcacctcggcatggcggggcttcgccgaagaacacctaatcttctcccaggaaattggaaggccccccagaattaaaaaacttgcttgatcccgaggaaaaaggagggttggggcacaaaagttccaggaaatcctatggcgagatttttggggcccttggcccccaaacctttttcctctccaaaaataaaaaaaaacccccggtttttttgccccccaaaaaggggggc

SEQ ID NO: 35400 - protein, 113 aa, Zea mays
  misc_feature: Ceres CLONE 1414762-F
  misc_feature (68)..(68): Xaa is any aa, unknown, or other
  misc_feature (69)..(69): Xaa is any aa, unknown, or other
MVLITLVRDYIDRMLHDIPGMKVLVLDPQTVGMVSVVYSQSDLLRKEVFLVETMDNASSSRESMAHLXXVYFLPTLANTFRSSAGTSAWRGFAEEHLIFSQEIGRPPRIKKLA

SEQ ID NO: 35401 - DNA, 648 bp, Zea mays
  misc_feature: Ceres CLONE 1414763-F
  misc_feature: Encodes the peptide sequence at SEQ ID NO. 35402
agtggatcccccgggctgcaggaattcgcacgagaccattacctagaacatcctaatcgaaaaataacacaacaatctctctcccctcactccctgtctgcagcgcgcagctttcaaagcgttggtagagatgtgagaggagacgcaagcataggccgccgtagccgccgccgcgcccgccgcggccgaggtattcgtgaccgaagctgcatctctcgatgcggaggtgtctgcgcggtcgtaagctcaagtcgaggccagggatgacaacaaacgcgactaggtggagctcaccgacgatgacgcggcggtggggaccggctcgttcatggaggaaagcatcgtggtggaacacctgccctacccggagaagaacgccgctcgaccagttcaagcagctgatcgctgccgccctcggcggaggtgagttcatcctgcctcccccggcgccgccgccgaatgccgatgagactaatgtggaggaacccagggtcgaagaacccgcctaagaagatccagcgttctactgcgcagctaccgcggagataatcaagccccaggtggctgcggatgcccccggtgaggatgtcatgacggaggtgccgtcgttcgatgaggaccacgctgataacctggctgatgtaacct

SEQ ID NO: 35402 - protein, 96 aa, Zea mays
  misc_feature: Ceres CLONE 1414763-F
MRRCLRGRKLKSRPGMTTNATRWSSPTMTRRWGPARSWRKASWWNTCPTRRRTPLDQFKQLIAAALGGGEFILPPPAPPPNADETNVEEPRVEEPA

SEQ ID NO: 35403 - DNA, 771 bp, Zea mays
  misc_feature: Ceres CLONE 1414763-R
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (748)..(748): n is a, c, t, g, unknown, or other
ataatattaatccctctcttcccaaactactcctactggtgtgnnnngnnnnnnnnaacgaattgggtaccgggccccccctcgaggtcgacggtatcgataagcttttttttttttttttttccaataacgatgtgaccatgtactcctgaatttcaacatagcaatgggaatccaatacacgcattgtgccgaatacatctacagaggaacagacattctccaacctttcattcccccacattttcgtcctccctgccctcatcaacaaccatccgtcacacaatgccattatacttctcccatctactgtcccaaaaacaagctcacttcggtttcaaccacactaactgtagaatgcgaaccctaaaaaagttcccagtcaattaatcaaccaaactaaaaggttccttctcacttctataatcctaaacaccgatttaagggtaggggccatgcagctagcgccccccccccggggtgagtgacaggtgctcttcaccttcgatctgcaaaggaaggtacttcttctcggaagccccggttttttaacgtttaaacaaaaatttttgatagagggggtcccaccgtcctattagataaagtcgtcccccgctatagaggaaaagacagtggtgctccacttaggcgagtatggttctaggagagggggccggccacatctaggagatccctagctcactggggttaagtgacctacgtgaagtcgcatcggtcgggtcggacnccattaccttcgcccgttcctcc

SEQ ID NO: 35404 - DNA, 752 bp, Zea mays
  misc_feature: Ceres CLONE 1414765-F
  misc_feature: Encodes the peptide sequence at SEQ ID NO. 35405
  misc_feature (7)..(7): n is a, c, t, g, unknown, or other
  misc_feature (9)..(9): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (35)..(35): n is a, c, t, g, unknown, or other
  misc_feature (49)..(49): n is a, c, t, g, unknown, or other
aaaaagnangacccnncnnnnacccacccatnccnccacacccccggtncccttaccaaactggcactccccgcggtggcggccgctctagaactagtggatcccccgggctgcaggaattcgcacgagaccattacctagaacatcctaatcgaaaaactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagccggatctgctgcggaaggaggtcttcctcgtcgagaccatggacaacgcctccagctccagggagtccatggcgcacctcaagggcgtctacttcctccgaccctccgctaacaacgtccagaagctccgcaggcacctcgccatggccgcgctttccccgagtaccaccttatttcttcgtccagtaatattgcaagcgcccccgcacgattccaaaaaaccttggcttgactccggaatggacccaggaagggttggaggcagccaaagtctccaaggaagctcccacatgccctgaattttttttggagccccatttggtccccccttacccat

SEQ ID NO: 35405 - protein, 139 aa, Zea mays
  misc_feature: Ceres CLONE 1414765-F
MVLITLVRDYIDRMLHDIPGMKVLVLDPQTVGMVSVVYSQPDLLRKEVFLVETMDNASSSRESMAHLKGVYFLRPSANNVQKLRRHLAMAALSPSTTLFLRPVILQAPPHDSKKPWLDSGMDPGRVGGSQSLQGSSHMP

SEQ ID NO: 35406 - DNA, 634 bp, Zea mays
  misc_feature: Ceres CLONE 1414769-F
  misc_feature: Encodes the peptide sequence at SEQ ID NO. 35407
gctctagaactagtggatcccccgggctgcaggaattcgcacgagaccattacctagaacatcctaatcgaaaaaaacggctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccgacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccctcaccttggcaggcttgtgtcacttgatatggggaaaattcttcctgaagggatcggtgaggttcaagaaatcatccacatgtggtgattatggtgtgggggctaagtcgccaaactaaatggatcccattataccattcttgaacgacccaaaccttatgatggatgggagggtgttgaaatccccccttgggaggttggggggtgggttt

SEQ ID NO: 35407 - protein, 125 aa, Zea mays
  misc_feature: Ceres CLONE 1414769-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTDNQVIAEVVEASVHDYEEGMRACFDAAKTWMAIPAPKRGEIVRQIGDALRAKLPHLGRLVSLDMGKILPEGIGEVQEIIHMW

SEQ ID NO: 35408 - DNA, 706 bp, Zea mays
  misc_feature: Ceres CLONE 1414770-F
  misc_feature: Encodes the peptide sequence at SEQ ID NO. 35409
  misc_feature (706)..(706): n is a, c, t, g, unknown, or other
aaactggagctccccgcggtggcggccgctctagaactagtggatcccccgggctgcaggaattcgcacgagaccattacctagaacatcctaatcgaaaaatctcgtcatgatgaccgttgtgctcggttggcggcctgatctcccagccgccgatagcggcgtcccccaccaccactggtccatgtacatggaacagcactcgccaccaccggcaggagggactgctggcgccgacgacataataattgccggcgtgcgtgggggggcacacggccgtcccggtgccccatcagacgctgtcgatcgacctctaccagcggtcttcctcgcatgcgcgggctacgaggcccgcggggggcaggggggatttcgaactacctctaggagaggtttccgcggtgtcgctcatcggctcgccgtcgatcaccgaatccacgggggtggacacggaggagctgacttgctgttgcccgtggaccagaagatcgagtctagaagctatcgggtggggtcccccaacctctaaacctcgagaatgacgtagttggtaaacactgccgcgcgtggggttggagggatctcgccccccatcacccgacattgcatggtggcctgctccgggtcacgggttcggagaaaaaaaacggggcctaccttttaggtaggggggcccacaatcgggaaaccaacccaagggggaacn

SEQ ID NO: 35409 - protein, 139 aa, Zea mays
  misc_feature: Ceres CLONE 1414770-F
MMTVVLGWRPDLPAADSGVPHHHWSMYMEQHSPPPAGGTAGADDIIIAGVRGGAHGRPGAPSDAVDRPLPAVFLACAGYEARGGQGGFRTTSRRGFRGVAHRLAVDHRIHGGGHGGADLLLPVDQKIESRSYRVGSPNL

SEQ ID NO: 35410 - DNA, 726 bp, Zea mays
  misc_feature: Ceres CLONE 1414773-F
  misc_feature: Encodes the peptide sequence at SEQ ID NO. 35411
aaagctggagctccccgcggtggcggccgctctagaactagtggatcccccgggctgcaggaattcgcacgagaccattacctagaacatcctaatcgaaaaattttcttctcccgttcacttctctttggcccgaaaccgaaagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccatttcaatcctttaccgtgtcattcaggacccatcttcttctgctgatgcactgagaacaaaagaagttgcaattacaaatcttacaaactacctcactaaagaaaacagagctgaggagctgcgtaatcttttgacccagctcagaccattttttgcagttattcctaaggcaaagactgcaaaaattgtccgtggaataattgatgctgtcgccaagatacctggaacatcagatcttcagatttcactctgcaaggaaatggtagaatggacccgtgcagagaagcgtactttccctccggcacgtgtggaggcaaggttggcagctctcctggtagagaatcaga

SEQ ID NO: 35411 - protein, 145 aa, Zea mays
  misc_feature: Ceres CLONE 1414773-F
MSSSMESSYLPATTESLAQAQEAKDASESISILYRVIQDPSSSADALRTKEVAITNLTNYLTKENRAEELRNLLTQLRPFFAVIPKAKTAKIVRGIIDAVAKIPGTSDLQISLCKEMVEWTRAEKRTFPPARVEARLAALLVENQ

SEQ ID NO: 35412 - DNA, 768 bp, Zea mays
  misc_feature: Ceres CLONE 1414787-F
  misc_feature: Pfam Name: Melibiase Pfam Description: Melibiase
  misc_feature: SWISSPROT Homolog: EC 3.2.1.22 Alpha-galactosidase
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
tttctctttttttnnnnnnntcatctttcattaatatttgattatgtgtatcaaagctggagctccccgcggtgccgtccgctctacaactagtgtatcccccgggctgcaggaattcgcacgagaccattacctagaacatcctaatcgaaaaaagctggagtaccgctgccgcacagactgcagcgcgtgcgcactgagtacgcaggtaggacgcgacgcagcgccgaagcaccaaggatggagcccgagattcagagtctgtgtccgagtacgacggccgtgctcctcctgctggccgcctgtctcgccgccgcggtggcatcgctcgacgctgcgctactacgccaggccgccgctgcctgcaggcggaagcgatcgacgcgtcctgctcgccaacgggttcgcattgacaccttatatggagtggaacacctgcaaccatttccagtgcaacctcaacaaggcgatcgctacggaacaccgctgatgcgctcgtcgccaccggacttgtaaaggttggctacacatatgctaacttaaatgaatgatgcgagtaatacgagagaaccacacaaacatacatgtgtcgctaacccccacaccttcccgacccggaaaacaaggccctgggcaaaatcacgttacacaccaaggggcaataaaaacttaagcgaatctactacataccgtcggagaaaaaggaacttggacacaaaaccaagcactgcccctgtccatccccctcggcactacccaactaaagag

SEQ ID NO: 35413 - DNA, 772 bp, Zea mays
  misc_feature: Ceres CLONE 1414789-F
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (372)..(372): n is a, c, t, g, unknown, or other
  misc_feature (421)..(421): n is a, c, t, g, unknown, or other
  misc_feature (423)..(423): n is a, c, t, g, unknown, or other
  misc_feature (442)..(442): n is a, c, t, g, unknown, or other
  misc_feature (454)..(454): n is a, c, t, g, unknown, or other
  misc_feature (500)..(500): n is a, c, t, g, unknown, or other
  misc_feature (519)..(519): n is a, c, t, g, unknown, or other
  misc_feature (538)..(538): n is a, c, t, g, unknown, or other
  misc_feature (546)..(546): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (589)..(589): n is a, c, t, g, unknown, or other
  misc_feature (611)..(611): n is a, c, t, g, unknown, or other
  misc_feature (612)..(612): n is a, c, t, g, unknown, or other
gatgacccccgggccccaccccaccaactcccccccgccgcccttcnnnnnnnccaaagtggcgctccccgcggtggcggccgctctagtaatagtggatcccccgggctggaggaattcgcacgagaccattacctagaagatcctaatcgaaaaaggaaccaaaaggggaggtgaccgcggaggtggtcagctctcctctcctcacattttcgggtcccctctccgccttccatggcaccgcattaccggtatttttagccgccggaggagacggcttgcgtagagagaggggaaaccagagctcctgactgttcctctctccctcctcacgggcgggctccgtctgttccgtccatccaccgccccggncggctcccggccagatccctctcctgcatggcttctttgcgaagtggcngnagaagacgatgggaggggncctctccagggncccgcggctggtttttcgccctgcctatccggcctatgcacgctanaataccgtgggacttgagngacccgcacgcgggcccgncaaacctncccggccccctcccgnnnttctcaagccccctggatgagcggncgtggagatatgggggaggtcnntagcgtctttcggggcaaaccgctatcccctcgcgcaagagaaaggaggcccccccccattcgaagctcgtggttgcgctcccctctccaacaggtgaatccaaggtcacgcgattatctgtgtcggtcatactttaggggacaaaggccagaaaaaaaa

SEQ ID NO: 35414 - DNA, 761 bp, Zea mays
  misc_feature: Ceres CLONE 1414792-F
  misc_feature: Encodes the peptide sequence at SEQ ID NO. 35415
aaagctggagctccccgcggtggcggccgctctagaactagtggatcccccgggctgcaggaattcgcacgagaccattacctagaacatcctaatcgaaaaactactctggtcgtcctcgcgccgccgcagcagcagcagcgacgcgaccgccggtaatggcttccaccgttgtgctccggaacgccggctcccgccgactcttctgctactccactctccgcgccgccgcaatattgggacccgccgcgccacctgatgcgcccgcggcggcgtcggcccagccgccaccgatggcaggaaccctctgggcgaggtccatggccactttcacgcgcacgaagccacatgtgaacgtccgcaccattgggcacgtcgatcacggcaaaaaccaccactcactgctggcatttaccaaaggttctggccagaggcaggggaaaggccaaaagcaattgctttttgaacaaaaatcaaacaggccccgggaaagagaagaggccaaaaggaaacccccatttgcaaccagcttcatggtcccaggatttgaaacaggttaaaaaggggtattatggcctccagttgaacttggcccacggtcctccccacaattttctcaaagaaacatgttaactccgggaagatcggctccaaatgggacggggggggaaatttttgggagggggcccatcctccggagggggccccaaggggccccaaaaaaaaaaaagcaacaattttttctttttgcccccccaggg

SEQ ID NO: 35415 - protein, 88 aa, Zea mays
  misc_feature: Ceres CLONE 1414792-F
MAGTLWARSMATFTRTKPHVNVRTIGHVDHGKNHHSLLAFTKGSGQRQGKGQKQLLFEQKSNRPREREEAKRKPPFATSFMVPGFETG

SEQ ID NO: 35416 - DNA, 831 bp, Zea mays
  misc_feature: Ceres CLONE 1414799-F
  misc_feature (1)..(1): n is a, c, t, g, unknown, or other
  misc_feature (35)..(35): n is a, c, t, g, unknown, or other
  misc_feature (36)..(36): n is a, c, t, g, unknown, or other
nacccccccccacacccccccccaacaaaagagannggccacatttaaacaaaagctggactccaccgcggtggcggccgctctatccctcacgcatcccccgggctgcaggaattcccacgagaccattacctagaacatcctaatcgaaaaattatccccagctttttctccaagcgtccgttcaggaagctgtccggcaacgagccgctcggcactgggcggtggccgtgcaagagcgatcgggaccgcatcgctcgtctgctcctccaggcctccgcctccctcatcatcactgcagcggcgagaagaacaagggacggtccggcggtggtctccactgacatcgcctaccatggctaccatgctgcgccggtgcatgcgggatctgcgcccgctgcggtctctcgcgaggccccccagaacgatcttcttcgagagtccaacaatttcttaaattaagaagcaaatcaaccaaaggcatctcccaagaagttctacccagaaagggttgcccccaggccccctcaggaacaacccttctccagccgggaaaggaaatggtttcaaaaggcttggctccttgggaaactctttgggggcccgggggcaaacaaacataatgggggcaaatcacagatttggggtaataataagattcttccaatttgagggggaaaaaaaatttgggctcttttaaggttaaaaaaaaaggaaaaaaagttcccgaaaagggggggatatatttaaacaccctgaaaaaaaactcctttttagaaaagaaaaagtgtggccccccatacacacaaatacggtggggcgggagacaag

SEQ ID NO: 35417 - DNA, 674 bp, Zea mays
  misc_feature: Ceres CLONE 1414804-F
  misc_feature: Encodes the peptide sequence at SEQ ID NO. 35418
aaagctggagctccccgcggtggcggccgctctagaactagtggatcccccgggctgcaggaattcgcacgagaccattacctagaacatcctaatcgaaaactagttttaagttaagccgccttctctctcacctcgatgcggcttgccaaccgccgatctgcccggccaaggattgttgagctcgccgcgggctaggtttccttccgtccaccatgacggggtcaggctcagctccgacccaaacaccccctccagaacccaagcataacgcccgccgccccgtcctcctcctggggccgccactcctagccgtcgccgttgccctcctcttgggcgtatccaacaacccgatgccccgccgattcatccgccttctctttggaacaaggacctccattctccgctcctcgccacctcctgacgcagcttacgaagcaaccggcgcgatacgcacaccatgtgctctatggatggccccattcgcctccggcggagtctactgctccgaggaatggacctacgtctccgcgcttgacgcgcacgccgccgacgctggtgctgggaaaataatttctcgctcggaatagagcaccacgctgatctcgactcgccggagttcttgctcggcctccccgagcgatctaggcagctggcgtacagactgcgctctg

SEQ ID NO: 35418 - protein, 38 aa, Zea mays
  misc_feature: Ceres CLONE 1414804-F
MAPFASGGVYCSEEWTYVSALDAHAADAGAGKIISRSE

SEQ ID NO: 35419 - DNA, 699 bp, Zea mays
  misc_feature: Ceres CLONE 1414805-F
  misc_feature (304)..(304): n is a, c, t, g, unknown, or other
  misc_feature (305)..(305): n is a, c, t, g, unknown, or other
  misc_feature (350)..(350): n is a, c, t, g, unknown, or other
  misc_feature (360)..(360): n is a, c, t, g, unknown, or other
  misc_feature (409)..(409): n is a, c, t, g, unknown, or other
  misc_feature (443)..(443): n is a, c, t, g, unknown, or other
tggagctccccgcggtggcggccgctctagaactagtggatcccccgggctgcaggaattcgcacgagaccattacctagaacatcctaatcgaaaagtagaagaagaagcagaagtactcaatcccgagactaacgccgagccgtgttgcggtctgcggagcgtgcttgccacactcacagtcgctcactccctgtgcagctgtgctcctgtcggttgtcgccccgcttcatctgtcgtctcctccagtgcagtccctccccccccctgtctcccgcccaactctctccagtctcctcgcgtnncgcagtcggctggcagggctgaaatcatggcggtcgaccccgcgncagtcgtggncggccttcctcaccctctcatggtcgtcatgctgggcaacatgatcaanacgaccacttctcctcccgtaccgagaaaatgcncttgagggcaaagggtgcccgatccaaccaatgaaacttggaaacaatggtgaaatggaacggggccaattgctggggaggggaggccctgtgggccccttacgggaaattaaccctttgtgggaccaaccaggcccaaaaaccccccccccgaggggttttggaaccttccccggggagagggccccggaaatccaccttccaaaaaccaaatggtgtggggttggggggggtttattggggaaattttttcccc

SEQ ID NO: 35420 - DNA, 674 bp, Zea mays
  misc_feature: Ceres CLONE 1414806-F
aagctggagctccccgcggtggcggccgctctagaactagtggatcccccgggctgcaggaattcgtacgagaccattacctagaacatcctaatcaaaaagtcacgctagtagtaggaaatcctagcgcgtcgctgcttccattaccgcctccgcaaccagcccgccgcgcccccgagcgtttcgttccgggagcggcaagactgggacacgccagccctttatttcgagctttctgcgtgcgggaggcacgttgacaggtgatggcgtccgatcccgaggcgacgacgctgaagttcacaccgacgtgtatcgccgcggcggtctgatctctcatcgtgctcgtctcgctcgtggccgagcgatgcctccactacctcgggaagaggctcacgaggaacaatcacaatccgctcttcgaggtcgctgctcaaggtcagagaagagttgatgcgtctagggatcatctccctgctgctgacagcgctccaggcgatgattcggaggacgagcatgcctgaacgctgtacattcacatgatgccatgcgagaatcctgatgagaacggcgttgaggtcgccaccgtgaatgcatatggtacggacgcttgtcacgatcgctagccgcctgatgctgccaggcgctgctgaggatggacaagtcacacggatgga

SEQ ID NO: 35421 - DNA, 675 bp, Zea mays
  misc_feature: Ceres CLONE 1414811-F
aaagctggagctccccgcggtggcggccgctctagaactagtggatcccccgggctgcaggaattcgcacgagaccattacctagaacatcctaatcaaaagaagaaaaacacaccccggatggtcgggcacgtaagccccgtctcgtcctccagatatcggccgccaccttcacctccaccgccccggcgcacgtgcgcgtctccatcgtcgccgcctctcctccttcggacacgactgaccttccactggcgccgacgaagaagacacataggaagaagctcaccgccaaacctcatccagatccagtcgctaccctccgaaagccgcatacggaacgtctcgtctcttcctttggatccggcagccggtgctcctcctccggatccggtggtcaactccatcacccccagcttcacctcccttagtcccccttcatccgcccctcacccacgtttctatatcgccacctctctcgttgtaaaagacactgaggatctgggaagtgaagccgttcccgcgtgaagcagcgccaccccttggcatccgcccgaccgcttggaagcaaggcccacgtcttccagcttcctacaggaagaggctgcgcgccctccaaaaggacaagaatttaggatggatgaagtcacccaagctgttgaaaatctgaagaaagag

SEQ ID NO: 35422 - DNA, 717 bp, Zea mays
  misc_feature: Ceres CLONE 1414818-F
  misc_feature: Encodes the peptide sequence at SEQ ID NO. 35423
  misc_feature (296)..(296): n is a, c, t, g, unknown, or other
  misc_feature (369)..(369): n is a, c, t, g, unknown, or other
aagctggagctccccgcggtggcggccgctctagaactagtggatcccccgggctgcaggaattcgcacgagaccattacctagaacatcctaatcgaaaaagaaacatagaaggcgtgtacaccaagaagaagccggccaaccaaccgactcccccgaccctcctgatcgatcgagggccccttgttctagccagttgtccccttccctctcgccggcgttgctcctgcctgctccaatgggcgctgcctctgccgccgcccccacgaaagacgcgaacatccccgcgacgatgncgggcgtgcagtacgactcctggcggcggggcgccgctggactcaagcatgtggaagttccggtccccttcgncaaaaagaatgagcttctgctgaagctggaggcaacaagcatccacccatgggactggaaagtggaaaaaagcatggctgagccttttcctgccccgaaaattacccttttaccccccggactgatggggaaaaaatccggggttgaatttgccccaaaaaaaaggggtcccaacccggaaaaaaaggggggtcatggcccccccttataaagggggggggttttgggaaataatgttggtccaaaaaaaatttccccccaaaagccccctttggttttttttgtaaaaaaagggggttgttctcccccccgggggggcctccccggggggggaaaaaacattgggaa

SEQ ID NO: 35423 - protein, 113 aa, Zea mays
  misc_feature: Ceres CLONE 1414818-F
  misc_feature (20)..(20): Xaa is any aa, unknown, or other
  misc_feature (44)..(44): Xaa is any aa, unknown, or other
MGAASAAAPTKDANIPATMXGVQYDSWRRGAAGLKHVEVPVPFXKKNELLLKLEATSIHPWDWKVEKSMAEPFPAPKITLLPPGLMGKKSGVEFAPKKRGPNPEKKGGHGPPL

SEQ ID NO: 35424 - DNA, 713 bp, Zea mays
  misc_feature: Ceres CLONE 1414819-F
  misc_feature: Encodes the peptide sequence at SEQ ID NO. 35425
aaagctggagctccccgcggtggcggccgctctataactagtggatcccccgggctgcaggaattcgcacgagaccattacctagaacatcctaatcaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcggtgcgtggctcgcccgcgccgaacttcctgctgacgtgagacccgggggccggtcagcaattggctgggggtccaaccacgggggcttacacaggggccgaaaaatttgcgaaaaggttcacccctcctggccaaccgctttcttggtttgcgaaatcccccctcctgggggccccccacccgaaactgccccccccacccatttttgggcacccccgggggcccccggtcctcttccccggagtcaaccatgggccgccccaaaaagggggggggtttttctctggccctcttttttgaaatgtggcccccccgccggaaaacaaag

SEQ ID NO: 35425 - protein, 185 aa, Zea mays
  misc_feature: Ceres CLONE 1414819-F
MGALRSLAISYPEFLVAGLCFVSLSALRHAMRERRQRAPLSWPVVGMLPFVLANLGRLYDAITDALHGSGCTLMFRGAWLARAELPADVRPGGRSAIGWGSNHGGLHRGRKICEKVHPSWPTAFLVCEIPPPGGPPPETAPPTHFWAPPGAPGPLPRSQPWAAPKRGGVFLWPSFLKCGPPAGKQ

SEQ ID NO: 35426 - DNA, 673 bp, Zea mays
  misc_feature: Ceres CLONE 1414821-F
  misc_feature (296)..(296): n is a, c, t, g, unknown, or other
  misc_feature (363)..(363): n is a, c, t, g, unknown, or other
aaagctggagctccccgcggtggcggccgctctataactagtggatcccccgggctgcaggaattcgcacgagaccattacctagaacatcctaatcaaaaaatctccccttccttcctttcctactcccacactcccccaccctccactagtactagtactagtaccacaaccaccccaccgggaaaaaacccaacaaggtgtagggtcgccgccgccgccagcgccgccgtgcagatcgctgccggatctacggcgctggggcacgggggtccccggatcgaagacgcctccgncgagaggttcggatggctatgccaaaagaaaaccctggggttaatgcgtggccagcattccatgggncggaacacgcgaggtcaagctgctgggaaatcgtccaaacttttggagctttccctttctgtgccatttggctgggaaaaaccgaaggaaaaacgaatgggcaaggggaagggaaaacgaggggtcttccctatgaacacaccacgtgcaagggttggacctttccaggcccccggcctaaaaggcgcacaggactccggggatggtgagcaactttgagcaatggttaactctaacaaaaaattttggtggttggaccccaaaaatttggaaaaaaacccttttttaagagctgggaaaaaacccggag

SEQ ID NO: 35427 - DNA, 699 bp, Zea mays
  misc_feature: Ceres CLONE 1414824-F
  misc_feature (242)..(242): n is a, c, t, g, unknown, or other
  misc_feature (420)..(420): n is a, c, t, g, unknown, or other
aaagctggagctccccgcggtggcggccgctctataactagtggatcccccgggctgcaggaattcgcacgagaccattacctagaacatcctattgaaaaaaaccctaacaacgcatttcgatctccagagcgggtcggccacatcccacaggcagaaccctacgagctgggtctctaccgatgggccgagccacagacagcagtgagtgctctctctctccctcgtggcgacaactgtgngaccgctgtcgctgcccttgtgcactggtctcggttgcttcgtgcggcaggtcacctgcgggctctttgcttcagacaagatccgccaggttgctgtgtgagctccacgctagctcttgctatcagccgagatttgcaactaggatattatcgatgaagatgatgccacagactgaangacatggatcatgcttggtgacaggatgagaataatttgttcacaaagaccaattcttcccataattccgcctttgggaaaggaaaaggttcctgaaagggaaaattaatggaaaaacttttggtttccctgggcttggggggttttccaaaaaggaacccaatgggaaaggggggttttgggggccccctttttttaaaaatttttcgccccagagggttggtggaagggttcaaaaaaaaaccccccccgccccaacaaaaaaaaaagagagggccc

SEQ ID NO: 35428 - DNA, 864 bp, Zea mays
  misc_feature: Ceres CLONE 1414825-F
  misc_feature (49)..(49): n is a, c, t, g, unknown, or other
tttttcctttctttttttttctttcttctcccgcccccggccggtcatntatcacaaactggagctccccgcggtggcgggcgctctagaatagtggatcccccgggctgcaggaattcgcacgagaccattacctagaacatcctaatctaaaaagcgcttcaacagtaatctctctgtgcctgcgacgacgactaggtgggttaccgccgtcgcgccgccgccgccgccgccgccatactaaaggcgcggggcctccctcggcttcttaccgggcgaccgaaaccacccactccccctccctgccctgaggtaccttgcccagtcctggatgttaggatgggcgggcgcttcgggccacggcttgccgcagcccccccgcgggtgctcttttggtggccaaagacgtggctggggtttcttgatcgctacctccaatcttcgtttggccggcttcgcgcccctttcttacaggacatcccaaactaaatgaagtaaacccggtgtccccccaacagtcactcgccgatgggcttggcccccgtcccctcttatcacgtacccccgccacctgggccatggtcttccactccacacctcgttcctttggaacaatccccgagcagtaatttcagattcatgttcccgggaaaatcacaccttccaaaatctagaaaaacacacaacgatctttaaaggagcacttttccccaacgacccttcctgcgccgcagcctccgcctctccgccaacaaggcccacgtagagaggccttacttgaacattgtcccttgcgcagaacccggcggtttatgcgttgtgtctataaacctccactccaccaacccctacgccccctatcgc

SEQ ID NO: 35429 - DNA, 680 bp, Zea mays
  misc_feature: Ceres CLONE 1414826-F
  misc_feature: Encodes the peptide sequence at SEQ ID NO. 35430
  misc_feature (559)..(559): n is a, c, t, g, unknown, or other
  misc_feature (560)..(560): n is a, c, t, g, unknown, or other
aagctggagctccccgcggtggcggccgctctagaactagtggatcccccgggctgcaggaattcgcacgagaccattacctagaacatcctaatcgaaaaaattttcttttagaaaacaagcaggcatcacctaattacttgtcctcgctcctctgaactactatatccagtccttaatccgatgccaattcctactggtctctgatcgccatgatccgcgtgtttttgggagcataaatgtgcagcgcagtccctgtgacaagctcctgtaacctcaatacaagctatgcagcagctcgtggcgttgctggtactgatctccctccccgtgcgcgcggcgcctgtctccggcgccggcgtcgtggtgacgctgttcacgcactccgacgccggccgcggcttcgcgaggcccgagctcgtgcggtgaatggcgcaccgagccagggcgcgccgccggctcctgtcctcgcacgaactccccgtgcgcgcgcgtgtgcgcgcaggtctcgtcgccgccgccgccgggattgcgacgaacgagtatctggtgcacctgnncggtcgcacgccgccgcgtcccgtggcgctcacgctcgacaccggcagtgacctcgtctgtacgcagtgcgcgccctgccgcgactgctttcgacagagcatcccgctcctggaccccgg

SEQ ID NO: 35430 - protein, 83 aa, Zea mays
  misc_feature: Ceres CLONE 1414826-F
  misc_feature: SWISSPROT Homolog: EC 3.4.23.12 Nepenthesin
  misc_feature (44)..(44): Xaa is any aa, unknown, or other
MAHRARARRRLLSSHELPVRARVRAGLVAAAAGIATNEYLVHLXGRTPPRPVALTLDTGSDLVCTQCAPCRDCFRQSIPLLDP

SEQ ID NO: 35431 - DNA, 665 bp, Zea mays
  misc_feature: Ceres CLONE 1414830-F
  misc_feature: Encodes the peptide sequence at SEQ ID NO. 35432
  misc_feature (471)..(471): n is a, c, t, g, unknown, or other
  misc_feature (472)..(472): n is a, c, t, g, unknown, or other
  misc_feature (502)..(502): n is a, c, t, g, unknown, or other
  misc_feature (538)..(538): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtgnncgcaggttgtgggggggaggccacctacgnactcgccaccgtgctcgcctttctcggcggtctcgncttcaccatctccgtctacatcatgtccaggcccaggcccgtgtacctcatcgacttcgcatggtacagccgggcgacgaggctcaggtggcccaaaggggaaggtcatcgacctggcgcgcaagcn

SEQ ID NO: 35432 - protein, 151 aa, Zea mays
  misc_feature: Ceres CLONE 1414830-F
  misc_feature: SWISSPROT Homolog: EC 2.3.1.119 Icosanoyl-CoA synthase
  misc_feature (87)..(87): Xaa is any aa, unknown, or other
  misc_feature (88)..(88): Xaa is any aa, unknown, or other
  misc_feature (98)..(98): Xaa is any aa, unknown, or other
  misc_feature (110)..(110): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELXXQVVGGRPPTXSPPCSPFSAVSXSPSPSTSCPGPGPCTSSTSHGTAGRRGSGGPKGKVIDLARK

SEQ ID NO: 35433 - DNA, 680 bp, Zea mays
  misc_feature: Ceres CLONE 1414833-F
  misc_feature: Translation starting site: 144
  misc_feature: SWISSPROT Homolog: EC 4.1.2.10 Mandelonitrile lyase
  misc_feature (248)..(248): n is a, c, t, g, unknown, or other
  misc_feature (680)..(680): n is a, c, t, g, unknown, or other
ggagctccccgcggtggcggccgctctataactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacngtcgtgaaagacccgccgctgccgcccagccgtgtcgtactacgactacatcatcgtgggcggcggaaccggcgggtgcccctttgccgccacccttgcggagcgttccccggtgtgttgttgaagccggcccctcccctacaaaaacacccgatgggaaaatggcccctttccgaaacgtttggaaacctccccggttcccccccaaattttttggagaaaaaaaggtattaaatccccccccggggggtgtggggggaaattttaaaaacccccttttaaaccggggaacaaaaaaaataagggggggccctttgaaaaacttggcccccccccgggctataccaggggggagaaaaaacttgttttatccccaccaaaatgtggcccccccaaacccccccctctgagggcctcctcttctcaaaacgn

SEQ ID NO: 35434 - DNA, 658 bp, Zea mays
  misc_feature: Ceres CLONE 1414836-F
  misc_feature: Encodes the peptide sequence at SEQ ID NO. 35435
  misc_feature (357)..(357): n is a, c, t, g, unknown, or other
tggagctccccgcggtggcggccgctctagaactagtggatcccccgggctgcaggaattcgcacgagaccattacctagaacatcctaatcgaaaacttctgccattccgccgaacaccttccccaatcgtgcgcctccggccatgggggaagcctccgacgcggcggtagccgtatctgcgcggctcctggagctggcggccgaagacgactctgcagcgctcggtgacctccttgcggcacacccgtcgcttgctgacgagcccgcgccgtggtactccccggcgcgcggcgcggagcctatgaccccgctcatggtcgcggcggcgtacgggtccgtggcctgcatcgatgtnctactctctccgcccccacaggacgaccccaccgcgcctcaccgtcgtccctctccacgcgcttcatcttgcagccggcggcggcgcctccgctgcgccgggtgcggaatcccgtcttctagctgctggcgccgaccccacgttgggcgaacacctccttggccgaccgtccagagttttcccccttccccccaatttggttccggtaaaaaacccccttttcttctcctctgaggggcaaaggaagggccccccaatcctcccctcccgaaatcaaaatggggccaacccccccccaccc

SEQ ID NO: 35435 - protein, 148 aa, Zea mays
  misc_feature: Ceres CLONE 1414836-F
MGEASDAAVAVSARLLELAAEDDSAALGDLLAAHPSLADEPAPWYSPARGAEPMTPLMVAAAYGSVACIDVLLSPPPQDDPTAPHRRPSPRASSCSRRRRLRCAGCGIPSSSCWRRPHVGRTPPWPTVQSFPPSPQFGSGKKPPFLLL

SEQ ID NO: 35436 - DNA, 664 bp, Zea mays
  misc_feature: Ceres CLONE 1414838-F
  misc_feature: Encodes the peptide sequence at SEQ ID NO. 35437
aaagctggagctccccgcggtggcggccgctctagaactagtggatcccccgggctgcaggaattcgcacgagaccattacctagaacatcctaatcgaaaaagaaaatacgcacctgctcctcactcttctttatatttttttctccatttgacaacttttgcttgtcgttcatgtatatgcatgaccctttcacacatatgatcagaagataagcacatgcaagacgatctcgcgtggatatgatgcatggatcaaacctaacctctatatcatcaccaaacgctcgtacatgatgctatacaattccatgattaaattatatataagcaaaaaaaaaagaaccgtacgtgcatacataaaattaagaattaatggctgccaatggacgacatatgcatggacaggtaagctggtgatcccactgaaccgggaggcgaccaacttccggtccatgatcgcgatgatcgacgtcaggacggatctgaagtcgctgccagtcagcggcggaccacaggaccgacggttgcaggtggtgggcgtctccgccgccgccggatccggaggagatgactactacttggacgtggagagcggcagcgcgacagtgccgctggtgcagcaacagtacgtgaacgggcgactcgtccgtctccgcaccttc

SEQ ID NO: 35437 - protein, 124 aa, Zea mays
  misc_feature: Ceres CLONE 1414838-F
MMLYNSMIKLYISKKKRTVRAYIKLRINGCQWTTYAWTGKLVIPLNREATNFRSMIAMIDVRTDLKSLPVSGGPQDRRLQVVGVSAAAGSGGDDYYLDVESGSATVPLVQQQYVNGRLVRLRTF

SEQ ID NO: 35438 - DNA, 787 bp, Zea mays
  misc_feature: Ceres CLONE 1414844-F
  misc_feature: Encodes the peptide sequence at SEQ ID NO. 35439
  misc_feature (19)..(19): n is a, c, t, g, unknown, or other
  misc_feature (20)..(20): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
tggtgggcccccccccccnncccccccgccccccttctgtccggnnntngtgaccaaagctggagctccaccgcggtggcggccgctctagaactagtggatcccccgggctgcaggaattcgcacgagaccattacctagaacatcctaatcgaaaaatctcttctcacgaacgtttacacgccgggtgcgcgcgctctgctctccctccttcccttgcccaactctcactctctcgcccgcgcggagcggacttgctttctggtggcaccgactggccggctgccaccgtctcctcctcgctggtgcccaggtcttcgtcggtcccttggtgtctgccccttatcctggtctttggcaggccctcgcctttcgcccgcgacgagcaccacctgcaggaacaaaatgaagtgcaatgcttgctggccggatttggaagggcaagctgtatcaacccacctgtggcccccccctcatgggccgaaggatgctaagaaaaatactccataatggatggtacatgtctaactttgcgaccccggggttcccccaaaagccctacggaaaccctaaggggaagataaacccacggtggattgatttcggaccaactactgggcaaagggcttgggaaatattcccccaaccaataacccttaatggacagaaggggaattctcgaaagggcgaaattgtttccacacagcttggaccacacacaggcgacaccgggcccgaacgtctgggataaaaaggaatggcaaccccgaacattgtcttggtgtac

SEQ ID NO: 35439 - protein, 111 aa, Zea mays
  misc_feature: Ceres CLONE 1414844-F
MLAGRIWKGKLYQPTCGPPLMGRRMLRKILHNGWYMSNFATPGFPQKPYGNPKGKINPRWIDFGPTTGQRAWEIFPQPITLNGQKGNSRKGEIVSTQLGPHTGDTGPERLG

SEQ ID NO: 35440 - DNA, 890 bp, Zea mays
  misc_feature: Ceres CLONE 1414847-R
  misc_feature: Encodes the peptide sequence at SEQ ID NO. 35441
  misc_feature (27)..(27): n is a, c, t, g, unknown, or other
ttttacgattgggtaccgggccccccntcgagtcgacggtatcgatattttttttttttttttttattttttttttttttttttttttttttttttttttttttttttttttttttttttttccccaacacccccaaatgctttttgttggaggatccctcgatacaaaaagggagcacttttgatttacttggggcacttgcaaaaattgttttttttcctctgggcccccactgcccccccatgttggcctaaattaacccgggtgatcacccccaaatctctactaaaacaccggccgattagctgggaaaccatttcaacgggaatgaactcccgggggggggcccaaaaggggaccttttccatctcccggggcaatgggggggccctgacaaggctgcccatggggttgacgggaaactttatttcctcaaacgggttgcccggcaccacccccttgtaaaaggaactgtcaaagggcatcttctgcacgtagtcgtcggggcacatttccccaaaggccccccccccccccttggaacgggaaaacaccctctgcaggaggtccccccccttgtaaaggggcccataaaagcgggcaaaatcggccaggtacttgcgcaagggcggtctcccccaccattcagggttcccggtgggggaacccccccaaaaaagggccctcggggacaatatcccccccgttttttcccccgaaaaaataaaagcccctccccaaaaaacaccttgggtcaccgttacccccgcgggaataccccccccccagggggttaccccgccccccggaaaacccccctttttatagagcctcgggggtggccctccctgagggaaaaaggagggtttccactcctctaaaaaaccac

SEQ ID NO: 35441 - protein, 84 aa, Zea mays
  misc_feature: Ceres CLONE 1414847-R
FYDWVPGPPSSRRYRYFFFFFLFFFFFFFFFFFFFFFFFFFPNTPKCFLLEDPSIQKGSTFDLLGALAKIVFFPLGPHCPPMLA

SEQ ID NO: 35442 - DNA, 670 bp, Zea mays
  misc_feature: Ceres CLONE 1414847-F
aaagctggagctccccgcggtggcggccgctctagaactagtggatcccccgggctgcaggaattctcacgagaccattacctagaaacatcctaatcgaaaaaggatcggcgatcggatcttgagctgctactgctactataccagcgctaactagcaccagccgccggacgactcacgctagatgaagaaggatccacgtgaacaatgtgactccgcggccgggactcctccgatctgctggctctgaccaccgcgatcgactgctactccgttgccaagcaggactaccaccccatgtacccgaaaggcaacagctgcatctgatgagaaccgatctcgcgcacacccgacgaggacgagcctacggcgacaataaccacctcacatagtgcaccggcacatcatgttccgccgttagcaaaagtctgcggccgcgttccaagaatgaggagatctgtaccatcgagggagagcaggccgctgatcatcagaactgctccgagaacctggttgcgatctccaactgttggacgggcaccacgagcgtgacgatactactgccgagaacgacctacactcatcagatcgcttctgttgcaaggccgttatggactctgagtacgaacagcaccgaagaatgtcacttcatgatgcagatctcctcgct

SEQ ID NO: 35443 - DNA, 890 bp, Zea mays; identical to SEQ ID NO: 35440
  misc_feature: Ceres CLONE 1414847-R2
  misc_feature (27)..(27): n is a, c, t, g, unknown, or other

SEQ ID NO: 35444 - DNA, 677 bp, Zea mays
  misc_feature: Ceres CLONE 1414849-F
  misc_feature: Encodes the peptide sequence at SEQ ID NO. 35445
agagctggagctccccgcggtggcggccgctctagaactagtggatcccccgggctgcaggaattcgcacgagaccattacctagaacatcctaatcaaaaaaagcccccgtccaccgacgaattccaaaccctgcctaggacctcggggccactcgccgcacgtcggccacgtccgcctccaccccaatacgatggtctatgacgagagcaaaaaacatctcctcggtctcagctaccctgaggtgccatggttgcgcaaaaggtataaccttcctgctaagaagacccactctcagatatcaagttcgctcgcctcgctgcttgaggcatctccatctcctgctcctcctcctgtccaattatcaaacatgcaagaagcatccacatggaatcatgctaaccacgaaagaggcccatacgatggcagggatgatggtacaccacttgtgcatgcgaaacatcaaaaaggagatcacacacctgttgatgaaacatctaaaaaggtgatggacactgccacgagtatacctccagtttctatgaaccatggaagaccagaatatgatggtcatctatcttctgacctgataactgctcataatttacagacccaattgtgacgagggaaatgcaactaatacaacgaatctagaatctgatgaagaagatgattgt

SEQ ID NO: 35445 - protein, 142 aa, Zea mays
  misc_feature: Ceres CLONE 1414849-F
MVYDESKKHLLGLSYPEVPWLRKRYNLPAKKTHSQISSSLASLLEASPSPAPPPVQLSNMQEASTWNHANHERGPYDGRDDGTPLVHAKHQKGDHTPVDETSKKVMDTATSIPPVSMNHGRPEYDGHLSSDLITAHNLQTQL

SEQ ID NO: 35446 - DNA, 788 bp, Zea mays
  misc_feature: Ceres CLONE 1414851-F
  misc_feature: Encodes the peptide sequence at SEQ ID NO. 35447
  misc_feature (350)..(350): n is a, c, t, g, unknown, or other
aaagctggagctccccgcggtggcggccgctctagaactagtggatcccccgggctgcaggaattcgcacgagaccattacctagaacatcctaatcgaaaagtgtatcgcggaattttttgggttctcgggctccgccgcgatcccatccccatccccgccttgccgttgccgttgccggcccccccggttctcccggagctttctttctggccggcgcagtagagaagcaagacagaattgcggcggcgcctgcccgcgcaaaggaaataatcagcactgtttggcaaaggcagctcctgacgcatggctagtacttaagggatacttatgtgcagaccatgaagatngatgacgaaagggcttaccaaactcatatttttcatgatcttgcatcctagcggagtcctaaaatagaactgggaggttgaaagaacaagtaatccccaggttggggcgaaaataaatgtttggagcaacccaatcaatctaaaatttactttggggagggtggacttttgaaggggggtaaaatccgaaaaacccctttgggggttccccctaaaaggggggtgtttgaaaaaaaaaaggggcaaaaaaaattttttccttggataagggccctttttttaaaagaggttcttttttaaaaaagatttctcccccaaaaaaattttcccaaaaaaaagagaaaaaggggggggttttatttttgtcccccaaaaaaaaagggggcccaaagagaaaaaaagtgtttctccccaaaccacgcggggatataaaaaaaa

SEQ ID NO: 35447 - protein, 74 aa, Zea mays
  misc_feature: Ceres CLONE 1414851-F
KAGAPRGGGRSRTSGSPGLQEFARDHYLEHPNRKVYRGIFWVLGLRRDPIPIPALPLPLPAPPVLPELSFWPAQ

SEQ ID NO: 35448 - DNA, 756 bp, Zea mays
  misc_feature: Ceres CLONE 1414853-F
  misc_feature: Encodes the peptide sequence at SEQ ID NO. 35449
aaagctggagctccccgcggtggcggccgctctataactagtggatcccccgggctgcaggaattcgcacgagaccattacctagaacatcctaatcgaaaaagatttggatgcgcactacatgcttaaggcgtgaacgcgaaagaggcgtccccatatcatcacaaacggcgataatggcagctgaagcacactacctttcatttggcaagttccttgaacttagtttttcaagccactcaaccgctagaagggtgccaatatgcgggcattcactcaatacggattgtctgcgctttttttgggttgggctccaaagatgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagatgattccagttatatagaggcgaacaagcttttgactatttctttcgttaattgggagcaacgtatagaggtgaacaaccttattaaaggaaattcttgtgcaaatcagagttcatacaatagatgaaacgatatcgtgattctcccaagggcggcttcatgagcaagaattctttcgccctgttccctaaaattttcccactgaaacctaaaaaaacgctttgaacattccctgggaagaattatattttcctttgtcgccacatgcactttaagcacgtattaaa

SEQ ID NO: 35449 - protein, 90 aa, Zea mays
  misc_feature: Ceres CLONE 1414853-F
MRTTCLRRERERGVPISSQTAIMAAEAHYLSFGKFLELSFSSHSTARRVPICGHSLNTDCLRFFWVGLQRCNVPVFLSRNLQCLQTTAYS

SEQ ID NO: 35450 - DNA, 740 bp, Zea mays
  misc_feature: Ceres CLONE 1414854-F
  misc_feature: Encodes the peptide sequence at SEQ ID NO. 35451
  misc_feature (352)..(352): n is a, c, t, g, unknown, or other
  misc_feature (466)..(466): n is a, c, t, g, unknown, or other
  misc_feature (686)..(686): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcgaaaaaaaaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttncactctgatctacttcaacatcttcctgggcgacatgtggtccgccatgaagtcggagaagaagcgccagaagcagcacgacgagaacgtgcagaaggtcgtgaagcggctcangcagaggaacccgaaagaaggacggtcttgtttgcacggccaggaagccctgaatcgctgttggcatgcggcaacgtgaactaccagcgtgcgaggaatttccagggtcgacctttcttcctcaggaaattccctgagacgaaaaaaaggaggagggtttgcaaggcccagccccctggcaacttgggtcaaaaaacagagctacctgcatgacttttgncccctgggggggnnnncccnaaattacaaaactcttttgggggggggggtgaaa

SEQ ID NO: 35451 - protein, 100 aa, Zea mays
  misc_feature: Ceres CLONE 1414854-F
  misc_feature (37)..(37): Xaa is any aa, unknown, or other
  misc_feature (75)..(75): Xaa is any aa, unknown, or other
MADVHEPLVRRKRKKVLVDYLVKFRWILVIFVVLPIXTLIYFNIFLGDMWSAMKSEKKRQKQHDENVQKVVKRLXQRNPKEGRSCLHGQEALNRCWHAAT

SEQ ID NO: 35452 - DNA, 744 bp, Zea mays
  misc_feature: Ceres CLONE 1414856-F
  misc_feature: Encodes the peptide sequence at SEQ ID NO. 35453
  misc_feature (683)..(683): n is a, c, t, g, unknown, or other
  misc_feature (744)..(744): n is a, c, t, g, unknown, or other
aagctggagctccccgcggtggcggccgctctattctagtggatcccccgggctgcaggaattcgcacgagaccattacctagaacatcctaatcgaaaagaactctcgacctacctaggcacaagagcgctagacgccgcagtgtagcacgcaccacccaccgagaggcggctgaggcgggctgatccgcatggagcaaaggccgcgcgcgcagagatgggcgcgccggtgcacgacgccctcgacttgttcctcctgctcctgaagggggcaggggcgaatatgaagaagaacgatccattggatccccggttgcgacttgcaggatcaggagctatggtcgccgcaacgactgcagacaactaccaatgcagtgctgcaggaattagcttctttatatgacgcggagaaggctgaggtttctgatgaagaggatgtcctgatgaaattccaagatcgtaagggtgaccctaccctcatctcctttgatgctgaacagatgtcaatggagtgacaagaggacatagaggaattatggctcctgtggaagaacgaccagttagagtcactagacgaagagttgctgtattaaaccaagagtctacccatagcctacatgtttgtacacaacccagttcaagtgccgccacaaaacatgatttgacccaccaccttattgttnctacacatcctagttccagtactgccacaagcatgagcccctccaagacatggatactgtn

SEQ ID NO: 35453 - protein, 61 aa, Zea mays
  misc_feature: Ceres CLONE 1414856-F
MGAPVHDALDLFLLLLKGAGANMKKNDPLDPRLRLAGSGAMVAATTADNYQCSAAGISFFI

SEQ ID NO: 35454 - DNA, 720 bp, Zea mays
  misc_feature: Ceres CLONE 1414859-F
  misc_feature: Encodes the peptide sequence at SEQ ID NO. 35455
  misc_feature (664)..(664): n is a, c, t, g, unknown, or other
aaagctggagctccccgcggtggcggccgctctataactagtggatcccccgggctgcaggaattcgcacgagaccattacctagaacatcctaatcaaaaaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggatggggctggtctccgttttcgggaacgatgtagacgcttactacgaccgcctgctagtcggggagagcggcatcgggcccatcgaccgcttcgacgcttctaagttccccacccgctttgccggtcagatccggggctcctcctccgagggatacatcgacggaaagaacgaccgccgcctttgatgatgcctccgatactgcatcgtcagggcaaagaagctctcgaggcctccgggatcgcccacggcttccagcccatggaaaagattgaacagaccccnggccggtgtggttgggggcactggtatgggtggcctcaggtggttttcggaagggg

SEQ ID NO: 35455 - protein, 114 aa, Zea mays
  misc_feature: Ceres CLONE 1414859-F
  misc_feature: SWISSPROT Homolog: EC 2.3.1.41 Beta-ketoacyl-acyl-carrier-protein synthase I
MQSLLLPTAAVAPVAPPCGRRNLPGRLSVRASATVVAAPRRETDPKKRVVITGMGLVSVFGNDVDAYYDRLLVGESGIGPIDRFDASKFPTRFAGQIRGSSSEGYIDGKNDRRL

SEQ ID NO: 35456 - DNA, 710 bp, Zea mays
  misc_feature: Ceres CLONE 1414861-F
  misc_feature: Encodes the peptide sequence at SEQ ID NO. 35457
  misc_feature (411)..(411): n is a, c, t, g, unknown, or other
  misc_feature (436)..(436): n is a, c, t, g, unknown, or other
  misc_feature (437)..(437): n is a, c, t, g, unknown, or other
  misc_feature (439)..(439): n is a, c, t, g, unknown, or other
  misc_feature (448)..(448): n is a, c, t, g, unknown, or other
  misc_feature (459)..(459): n is a, c, t, g, unknown, or other
  misc_feature (460)..(460): n is a, c, t, g, unknown, or other
  misc_feature (470)..(470): n is a, c, t, g, unknown, or other
aaagctggagctccccgcggtggcggccgctctagaactagtggatcccccgggctgcaggaattcgcacgagaccattacctagaacatcctaatcgaaaagaaaatcgagtggaaaagcatcaatcgagtgctgcgctagttgcctggttcgtcccaacaaattccaccgggaatcagggtcgtccggcagcggctgaggcgtctgggttctggaggagcggccgtcggtgaggggggatggggggcggcggcggatcctccgggccggagctgtcgacggacaacatgaaggggatagtcctggcgctgctctccagcggcttcatcggcgccagcttcatcatcaagaagaagggtctccgcccgggccgctgcggcctccggcgtccgtgcagggtggtaggcggntactcatacctcatgagcccctggnngntggggttgncatgatcattnnatgattgtangtgagattgcccaatttcgtggcatatgcttcccgcccccgctgttctggttactccccttggagactcagcataatgggtagtgcagtgctggctcatttcattctgaacgagagctgctggccctcgggggctcggctgcgtgagtgcattgcagggtctggggtcattgttatcccgctcacaggagcaggaaatacttccgtaaggaatatggaaatgcgaccaacctgtttctgt

SEQ ID NO: 35457 - protein, 69 aa, Zea mays
  misc_feature: Ceres CLONE 1414861-F
  misc_feature (66)..(66): Xaa is any aa, unknown, or other
  misc_feature (67)..(67): Xaa is any aa, unknown, or other
MGGGGGSSGPELSTDNMKGIVLALLSSGFIGASFIIKKKGLRPGRCGLRRPCRVVGGYSYLMSPWXXGL

SEQ ID NO: 35458 - DNA, 752 bp, Zea mays
  misc_feature: Ceres CLONE 1414863-F
  misc_feature (357)..(357): n is a, c, t, g, unknown, or other
  misc_feature (387)..(387): n is a, c, t, g, unknown, or other
  misc_feature (388)..(388): n is a, c, t, g, unknown, or other
  misc_feature (552)..(552): n is a, c, t, g, unknown, or other
  misc_feature (558)..(558): n is a, c, t, g, unknown, or other
  misc_feature (559)..(559): n is a, c, t, g, unknown, or other
  misc_feature (567)..(567): n is a, c, t, g, unknown, or other
  misc_feature (568)..(568): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (715)..(715): n is a, c, t, g, unknown, or other
  misc_feature (718)..(718): n is a, c, t, g, unknown, or other
  misc_feature (719)..(719): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (730)..(730): n is a, c, t, g, unknown, or other
  misc_feature (731)..(731): n is a, c, t, g, unknown, or other
  misc_feature (736)..(736): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (742)..(742): n is a, c, t, g, unknown, or other
  misc_feature (743)..(743): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
caaagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggaagggctctngaggcctccgtcgccagctccccgccgccnnaaggccgccgccgtcggcctccctcctgggtggcgcgacatgcagcacccggctgccttaacggcgcggtggcctccgtcccccggcgcggcggaggtggccgccccccgggttatcggatgggcgccggggcagcgacgcagcagcagcagcagcacgggcgncggggnncgacgacnncccctccgacggttctctcggcctccaaacgccaccgtagcgtccttcacaaccactttccgggtccgggtcagcgggacctcggggggggnnnanntttagaggcccnnnnnnnnntnnnnnnnnnnnnnnnnnnnnnnnnnnntntgnnannnngnnntnntgggngnnngnngnnngggtg

SEQ ID NO: 35459 - DNA, 740 bp, Zea mays
  misc_feature: Ceres CLONE 1414864-F
  misc_feature: Translation starting site: 444
  misc_feature (541)..(541): n is a, c, t, g, unknown, or other
  misc_feature (547)..(547): n is a, c, t, g, unknown, or other
  misc_feature (548)..(548): n is a, c, t, g, unknown, or other
  misc_feature (552)..(552): n is a, c, t, g, unknown, or other
  misc_feature (553)..(553): n is a, c, t, g, unknown, or other
  misc_feature (558)..(558): n is a, c, t, g, unknown, or other
  misc_feature (590)..(590): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (621)..(621): n is a, c, t, g, unknown, or other
  misc_feature (622)..(622): n is a, c, t, g, unknown, or other
  misc_feature (637)..(637): n is a, c, t, g, unknown, or other
  misc_feature (645)..(645): n is a, c, t, g, unknown, or other
  misc_feature (646)..(646): n is a, c, t, g, unknown, or other
  misc_feature (669)..(669): n is a, c, t, g, unknown, or other
  misc_feature (693)..(693): n is a, c, t, g, unknown, or other
aaagctggagctccccgcggtggcggccgctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaaaaaaagggcggcggtggaggcatgccccggcgatgacgggctggatggactttgggttggaggacgaggacgcggacccttcggctgaggcgaggaaagaggaagggctcgtcgtcgctgagggacctcncgaggnngcgnngcggncaggggagaagaagctaaaaaatgcgaggggnaggacgacggnnngaggggaagaacactggnnatgggaaggaaaagncgggatanncaggagaaaggaactccagcggntagggatgacccagatgatggggnaaaaaggaaaatccaggagctctgggaaaccatgggttgggggggaa

SEQ ID NO: 35460 - DNA, 731 bp, Zea mays
  misc_feature: Ceres CLONE 1414866-F
  misc_feature: Encodes the peptide sequence at SEQ ID NO. 35461
  misc_feature (460)..(460): n is a, c, t, g, unknown, or other
  misc_feature (467)..(467): n is a, c, t, g, unknown, or other
tggagctccccgcggtggcggccgctctagaactagtggatcccccgggctgcaggaattcgcacgagaccattacctagaacatcctaatcgaaaaaaagcaaagccaacgggatctccctctcattccagaggactccgcgtcgccaggcccgcttcgcgtgcgacgccggcatatagggtttcgccggcgccggcgatggacccaccccccgtgagccccgatcgctgggggcccagtcagggcggctggcgtcgggccctccggcctccgccgatatggcctcaatttctccgcctccagcctcctccaggcccccatcgcggccctccttgagtactccggcgtagtccagtccggccctgccctggcggcgcgccacccgtccgcgggggccctcgtcgccgttgtccggcgtcgggaggtcgatggtcttctctccgctgccgccgctggggnaccgggnaggtttcgatccggattcagggcggtccaggcgacacggaggccacgggcggggccggatgcggggacctcgtcccgagatttgatcgaggcgacccgccgctcctgaggttgaccaggccctcgctccggacagggatgcaagtgcttacgaagctaaagtcaaagggtgtcaggttccgtactttcgtgaaacgcggcccagcaccgctcgaacaatgtttttacctgtaccacatccggcgggggcccagaaacataattg

SEQ ID NO: 35461 - protein, 42 aa, Zea mays
  misc_feature: Ceres CLONE 1414866-F
MQVLTKLKSKGVRFRTFVKRGPAPLEQCFYLYHIRRGPRNII

SEQ ID NO: 35462 - DNA, 695 bp, Zea mays
  misc_feature: Ceres CLONE 1414869-F
  misc_feature: Encodes the peptide sequence at SEQ ID NO. 35463
  misc_feature (339)..(339): n is a, c, t, g, unknown, or other
tggcggccgctctataactagtggatcccccgggctgcaggaattcgcacgagaccattacctagaacatcctaatcgaaaaaccagaaacccgcgaatcaatcccgaatcccgatcgaccggcggcgcgggaggcgatgccggacaaggcggtggacgacgtcatggaggccgcggtgggggcccacttcagcggcctccgcctcgaggcgctgcgcctctccacctctgcgccctcttccccttcctcctcccccgccgccgcggcgcacacgcactccaacggagccgtctacgccaacggcaccaccgagcttccctctcctgccgctgcccggnagccattcgtcatcggtgtttctggagggacggcgtcggtgaagacgacggtgtgcgacatgatcatccagcagctgcacgaccaccgtgtcgtgctcgttaaacaggattcgttttaccgtggccttactgctgaagagtctgcacaggcacaagactattattttgatcaccctgatgcatttgatacgaagcaacttctataatgcctggggcaactggaatgcgccaaactgggaaagcccccatatatgaatcccagaaacatcccccggggttcggaaagttttaaaaaggcaaggctccaacccctttattttgggaggctttttatcctcccggcccaaagagccgca

SEQ ID NO: 35463 - protein, 135 aa, Zea mays
  misc_feature: Ceres CLONE 1414869-F
  misc_feature: SWISSPROT Homolog: EC 2.7.1.48 Uridine kinase
  misc_feature (68)..(68): Xaa is any aa, unknown, or other
MPDKAVDDVMEAAVGAHFSGLRLEALRLSTSAPSSPSSSPAAAAHTHSNGAVYANGTTELPSPAAARXPFVIGVSGGTASVKTTVCDMIIQQLHDHRVVLVKQDSFYRGLTAEESAQAQDYYFDHPDAFDTKQLL

SEQ ID NO: 35464 - DNA, 702 bp, Zea mays
  misc_feature: Ceres CLONE 1414870-F
  misc_feature: Pfam Name: Peptidase_M18 Pfam Description: Aminopeptidase I zinc metalloprotease (M18)
  misc_feature: SWISSPROT Homolog: EC 3.4.11.21 Aspartyl aminopeptidase
  misc_feature (674)..(674): n is a, c, t, g, unknown, or other
aaagctggagctccccgcggtggcggccgctctataactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcggggctcggggaacgcggtgttgccatcgcgaggaaggtcggaagttcgctgttcgcccgccggatcggcaccgtcgccaccgcccatggcaaaccgtcgcccccgtcgtctccgacctcgtcgacttcctcaacgcgtcgcccaccgcctttcacgccgttgacgaggcgaagcggcggctgaaaggcggcggggttcgtgcagctgtcggagcgggaggaagtgcgcggctctcgaggccgggcgcaagtacttcttcagacgcaaccactccactattgtcgcttttgccatcggcgcaaaatacgttgctggggaatgggttccacatcatcggggcacacactgacagcccttgcctgaggctcaagcctggctccaaggtaaccaaaggaggtaacctggaggtgggggttcaaacgttggggggngggtatctggtcaacctgacttatacat

SEQ ID NO: 35465 - DNA, 672 bp, Zea mays
  misc_feature: Ceres CLONE 1414871-F
  misc_feature (177)..(177): n is a, c, t, g, unknown, or other
  misc_feature (184)..(184): n is a, c, t, g, unknown, or other
  misc_feature (189)..(189): n is a, c, t, g, unknown, or other
  misc_feature (193)..(193): n is a, c, t, g, unknown, or other
  misc_feature (194)..(194): n is a, c, t, g, unknown, or other
  misc_feature (266)..(266): n is a, c, t, g, unknown, or other
  misc_feature (280)..(280): n is a, c, t, g, unknown, or other
aagctggagctccccgcggtggcggccgctctagaatagtggatcccccgggctgcaggaattcgcacgagaccattacctaaaacatcctaatcgaaaaagaggctaaacccccgtctaaccctgctgccgtgccgcttgccactactccgcttcgttctccgcccgcctccccgnacgtccngaaancttnnctagatgaaggggatagccattggcgtcaacgtgtgtgatggaagtcaggggactggggcagctcctggcgncgcttggccgcggngtttcttcgtccggggcattcggggaacccggccccggcctcctttcgccgggggagaaaccgaagccgaacaaggccaacccgaaagctggtcaaggaatgggttggttgttttccccccccgaaccaccccggggggccctcatacccggggcccttgaaaaaaaaaccggggaaaaaggcaaagtttttctttttaaaaaggggggggggggggggcaaacccgcgggggggtgcttttcccatggggggccccccggcgtttgtgaaaaaaaattttttttcaaagggggtaaaaaggagaaatttcccccaaaaaaattttcttttgacccttttctcggggtttgtgaaaaaaaaaggggggggcccaccatcacaaaaaggggga

SEQ ID NO: 35466 - DNA, 854 bp, Zea mays
  misc_feature: Ceres CLONE 1414876-F
  misc_feature: SWISSPROT Homolog: EC 3.1.3.16 Phosphoprotein phosphatase
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (830)..(830): n is a, c, t, g, unknown, or other
caccacttnnntctcacctctcctctcaaccaccccctccaaagctggtgctccccgcggtggcggccgctctatcctagtggatcccccgggctgcaggaattcgcacgagaccattacctagaacatcctaatcgaaaagttgtgcggttaagagactttacgtctctagtggtttctatttctgagcgagggtttatccgccaggggcggcgcgacgcgctgggagttgagctgagatttccttccgatcacgatcccttccaggcgaggggacggactaggcggcgcgcgacgacctcttccgacggctcctcgaggcccgcggcgggcgcaccccgcgcaacgatgaggcgaccgacgctgagatccggcgcctctgcgccgccgccaaggatgtgttcatctcccaggccaacctcctgcagctcgaggcccccctcaagatatgcgctgacgaccgtggtctaatattgaaaaccgtctcgattatttggagtgggggggcttgccacacaaagccaactatcctggttgctgggggaactaaggttggtaggggcgtaacactatcctcagaaagccaaatgcccttccccttggccccactaaactttaggtcccccagacaaaccatcttttctctctccggggccaacccatgtgtacgcccccccctcgccacacccgaataacacggccttccttctggctgcgaaggaaagaaggcctatttccactggtctcgtgatctcgggaaaaattattccccccaacttgggtttagacttgcccgtcccccgcggggccttgcctcttatcggcgtggncacgagacccgccccgacttcgcc

SEQ ID NO: 35467 - DNA, 728 bp, Zea mays
  misc_feature: Ceres CLONE 1414883-F
  misc_feature: Encodes the peptide sequence at SEQ ID NO. 35468
  misc_feature (193)..(193): n is a, c, t, g, unknown, or other
  misc_feature (225)..(225): n is a, c, t, g, unknown, or other
  misc_feature (444)..(444): n is a, c, t, g, unknown, or other
  misc_feature (552)..(552): n is a, c, t, g, unknown, or other
  misc_feature (670)..(670): n is a, c, t, g, unknown, or other
aaagctggagctccccgcggtggcggccgctctataactagtggatcccccgggccgcaggaattcgcacgagaccattacctagaacatcctaatcgaaaaataccgacgcgagcacgcgccgagcaacgtctcgaaaaggccatgcaggacggcggcgaggtgctgttcctggacggcgtcggggaggtcnccgtcaccatcggccgcaacggcctctctgcncggcccctccacccggaactgatctcttcatgttggtcgtccattacactgcagcctaaattagacagcaaaatcaacttttcagatgtttatgccatagagatgcttgataagggtcgtatctgtgggccttggaataccacgactgctattcagggcaggaaaaatattgagatgcaccggtttgtcgtacttgggattacccagaagagggaaacncccttctccgtgggtaccttgtgaatttattttttggccacaagaactttgagaatctggcaagatgggtttcggcatttcatttcctgcatacccgatggcggcggnagccccaacgaccttcttgctatcttgcccatcccttgggtggacaagggcccgggccccagtaccttcgccaaccggttctcccgtttgtttcttcacggacgcctccactcccgtnttctcttcccggctacagcctgtttccccctccgttcttcttttctctctttttccct

SEQ ID NO: 35468 - protein, 107 aa, Zea mays
  misc_feature: Ceres CLONE 1414883-F
  misc_feature (17)..(17): Xaa is any aa, unknown, or other
MQDGGEVLFLDGVGEVXVTIGRNGLSARPLHPELISSCWSSITLQPKLDSKINFSDVYAIEMLDKGRICGPWNTTTAIQGRKNIEMHRFVVLGITQKRETPFSVGTL

SEQ ID NO: 35469 - DNA, 766 bp, Zea mays
  misc_feature: Ceres CLONE 1414888-F
  misc_feature: Encodes the peptide sequence at SEQ ID NO. 35470
aagctggagctccccgcggtggcggccgctctagaactagtggatcccccgggctgcaggaattcgcacgagaccattacctagaacatcctaatcgaaaaacgcgaccactctgatacaggtcaccagcggtgggccccactacccagacgggtcctggttcctccccctccaagccggctctgaaatttgaggcccatagccccgtcggcccccatcgccacgccgccggccacgccccagacgaccccgcccgccgccgccgcctcccgctccctccgcgcgcagccctcgtccggccgcccgggtccgagcccgctcgctcctcctccccacgttggacagtttaagtgtggcttcattgcatgagtagttgcagttagcgtggcttttctccgtgcttgctcctggtcgtgctttgccttgcaaaggaaggaatcatgacatctgttgttcacagtgtttcaggtgacccacaggcctgaggatcaaaatcaacagaagaagcaagctgaacctggggaccagcaagaagccccagttactagttcagatagccaaccaacagtaggcacaccatcaaacagattatgtggcaccctatgcccctcatgacatgagccatgcaatggggtcatacgcttatccaaatatgacccatactatggaagcctttatgcagcaagcttacgagggacagccattgatgatcccaccggtagttggaatgcatccgggctggcttacctttgcatacgaagcaatt

SEQ ID NO: 35470 - protein, 50 aa, Zea mays
  misc_feature: Ceres CLONE 1414888-F
MSHAMGSYAYPNMTHTMEAFMQQAYEGQPLMIPPVVGMHPGWLTFAYEAI

SEQ ID NO: 35471 - DNA, 776 bp, Zea mays
  misc_feature: Ceres CLONE 1414890-F
  misc_feature: Encodes the peptide sequence at SEQ ID NO. 35472
  misc_feature (498)..(498): n is a, c, t, g, unknown, or other
  misc_feature (565)..(565): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaagactattcttcttcgtccctgatttttatccccaaactcaccgccggggcacaacaatccagttctcctttcgccggaatctgtccctcctccccctcctccccgcctctgcgggtactggaccaccgtggagcgggcattcatccaggctaggtccattccttcctttgctcgttctcttctccatcgcggaagctccacccgagttgacgccagaagagaatcggtgccctagggtgttctcgcagaattattttccagaagatttgcagatcgagtcgaaccctatgccccacgttaagcctgccgccggcctgcccccttaccaccaccgggcgctccctggccccggttcagggtccagttcccacggggacatgtgatgaggcaccgggnaggtccgtgatcagtacggggcggctgggggccgaagatgactttaaccacggcgtggggcacgggncccgctcccgtcccctacgacatgctggnctcgctgcccccccaccggaggtcctggagcagaagcttgtggcacagcacgggggagatgcagaaactggttaatagagaaacggccggttggctgcaagccacggcctcgttgaggaagaactagccgggccgcaacagaagctgcaaagctgcaagccccaaggggaagccgcaaagcc

SEQ ID NO: 35472 - protein, 31 aa, Zea mays
  misc_feature: Ceres CLONE 1414890-F
MPHVKPAAGLPPYHHRALPGPGSGSSSHGDM

SEQ ID NO: 35473 - DNA, 714 bp, Zea mays
  misc_feature: Ceres CLONE 1414894-F
  misc_feature: Encodes the peptide sequence at SEQ ID NO. 35474
aagctggagctccccgcggtggcggccgctctagaactagtggatcccccgggctgcaggaattcgcacgagaccattacctagaacatcctaatcgaaaagcaccgcaccgcaccgcaacgcgccaccgatccaccccgcgtcctcggcctccctccctccggcgagcggcggcgcgggcggccatggaggtgttctactacgtcgtgttcggcgcgctggccgccgtcgtggcggggctcgagctcggcaagagcggcaaggaccgcgtcgccaccacctccgccttcaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctccatgctcttcggcaccatcgtcggctccctcgccgacaaacaaggccgcaagaggggctgcatcacctactgcatcagctacatcctcagctgcatcaccaagcactcccccgagtacagggtcctcatgatcggccgcatcctcggagggcatcgccactcgctgtcttctccgctttcgagtccgggctcgtcgcgagcacaacaagagagctttgacccgcagtggctgtcataacatctccaagccactttcctgggaatggcttattgcc

SEQ ID NO: 35474 - protein, 163 aa, Zea mays
  misc_feature: Ceres CLONE 1414894-F
  misc_feature (4)..(164): Pfam Name: DUF791 Pfam Description: Protein of unknown function (DUF791)
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADKQGRKRGCITYCISYILSCITKHSPEYRVLMIGRILGGHRHSLSSPLSSPGSSRAQQESFDPQWLS

SEQ ID NO: 35475 - DNA, 759 bp, Zea mays
  misc_feature: Ceres CLONE 1414900-F
  misc_feature: Translation starting site: 162
  misc_feature (567)..(567): n is a, c, t, g, unknown, or other
  misc_feature (586)..(586): n is a, c, t, g, unknown, or other
  misc_feature (596)..(596): n is a, c, t, g, unknown, or other
  misc_feature (660)..(660): n is a, c, t, g, unknown, or other
  misc_feature (718)..(718): n is a, c, t, g, unknown, or other
caaagctggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagttacagatgttccagtgtttaccaacagagtttctcgtacgtaccgggcaaaatcagtgacagttccagatcacggagttgatgtgtgtcctttggaatacaatgagtatgtcccctgccatgatggagcctatataagcagcttgaagagcctggatacatctaggcatgaggatcttgaaagtatttgtcctccatgggagaagcggttgttttgtttgntgccccctccaatgactancagatacccnatagatgccccacaagccgagactacgtatggcgtagtaatgtcaaccattcacatcttgctgnagtcaaaggaagacagaactgggtgcatgagaagggcaaattttgttggtttcctggnaggtgcactcaccccaaacatggtgcatcagaatacataga

SEQ ID NO: 35476 - DNA, 736 bp, Zea mays
  misc_feature: Ceres CLONE 1414901-F
  misc_feature: Encodes the peptide sequence at SEQ ID NO. 35477
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaatcgatccgccaccacgccacaaaatcctctcctactccggcagttctgctcgccgccgcctccacgatgacggaagacgtgcagatgaacgactcggagccccagcctgcggcctcagctcccgccgtcggggcgccggcgctctccactctacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgccttcctcgccttcgcgctacccgcgtcctccgaagcctacggacgcctcactgccctggtgcccaaggaagatgatactgagatggatgttgatgctgcagctccagcaactcagatttcaatcaaacatggtctccctgagattgaatatattgctacttgctcgtactgattttccttattgatcatagaaatatgatgaggctaaggcatgcgccagtgggagcattgctccgcctgaagaactaaacccggagaactggtgatgtttnggcatcacgactggacttctattacccctaagtggatgaacttacaaacagcttgctgaatccgggggaaattggctgct

SEQ ID NO: 35477 - protein, 128 aa, Zea mays
  misc_feature: Ceres CLONE 1414901-F
MTEDVQMNDSEPQPAASAPAVGAPALSTLHHLKEIASVIEAGSLSKEVRRISRAFRLTVALRRRLAARDVSAFLAFALPASSEAYGRLTALVPKEDDTEMDVDAAAPATQISIKHGLPEIEYIATCSY

SEQ ID NO: 35478 - DNA, 724 bp, Zea mays
  misc_feature: Ceres CLONE 1414902-F
  misc_feature: Encodes the peptide sequence at SEQ ID NO. 35479
  misc_feature (519)..(519): n is a, c, t, g, unknown, or other
  misc_feature (573)..(573): n is a, c, t, g, unknown, or other
  misc_feature (574)..(574): n is a, c, t, g, unknown, or other
  misc_feature (621)..(621): n is a, c, t, g, unknown, or other
  misc_feature (622)..(622): n is a, c, t, g, unknown, or other
caaagctggagctccccgcggtggcggccgctctagaactagtggatcccccgggctgcaggaattcgcacgagaccattacctagaacatctaatcgaaaactcgaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatacttaagatgttggaagttgagcatccagccgccaaggttcttgttgagttggctgagctccaagatcgtgaggtaggagatggaactacttccgttgtcatcatagcggcagagttactcaagagaggcaatgatcttgtgaagaataagatccatncaacctctataatcagtggctacaggcttgctatgcgtgaagcctgcaaatatnngtgaggaaaagtagcagtcaagggtgacaaacttggaaaagatcccnntatcactctgcaaaactagcatggcttcgaattggataatagtgacagggatttcttggcaactttggtggtgaggcagttcaggcgggaaaaactacaagg

SEQ ID NO: 35479 - protein, 134 aa, Zea mays
  misc_feature: Ceres CLONE 1414902-F
  misc_feature (117)..(117): Xaa is any aa, unknown, or other
MAITAPTPDILGERQSGQDVRTQNVMACGAVANIVKSSLGPVGLDKMLVDDIGDVTITNDGATILKMLEVEHPAAKVLVELAELQDREVGDGTTSVVIIAAELLKRGNDLVKNKIHXTSIISGYRLAMREACKY

SEQ ID NO: 35480 - DNA, 882 bp, Zea mays
  misc_feature: Ceres CLONE 1414904-F
cccttcacccttctctctaataccacacttctctcttccactcaacaaagctggagctccaccgcggtggcggccgctctagaactagtggatcccccgggctgcaggaattcgcacgagaccattacctagaacatcctaatcgaaaagcttcgtggccgccttttttcagagaaaacagagggaggaaagaaaaagctcacccccctctctcttcccaccacctctctcacgtgtgtgaggtggcgagcccaaggaggagcgggaggccacaagtccgatccgcccgtatctaatccgctcgagcgcagcggctcgttcctcgcgggggcgcacggttggcatttcgagtgctgagacatcggcttcatcgaatcctaaagcacgggttgagccctggctggctccctttgctgcctaagccttcttcccctgggcccaaggggcgtctccagcaccattccgcgaaagaacttggcttgatgcaaccacccggatactttgaaccgccccgcggaactggccgcaacacccaaatggtcaatccagggaaacatgacagtggaaggcttccacgccaaaacccacttcccaaaggctcaatgggcacacagggtctagccttcaataaatgcaaggccaaaacgacggacgggaggggaatacccctaaaccttgccccccaaagacaactcccaacaaccacaactgcccacaattcgaaacactgcctacctatgagggcgtggaaacaaccactctctatattgcgccaccctcaccaatcccgcgccacactgcgttttgacatggtaatctcctaatcaataccccaaacatgggggtgagagaagaaaaattccgggtccccgcggtggacaa

SEQ ID NO: 35481 - DNA, 732 bp, Zea mays
  misc_feature: Ceres CLONE 1414909-F
  misc_feature: Encodes the peptide sequence at SEQ ID NO. 35482
  misc_feature (623)..(623): n is a, c, t, g, unknown, or other
  misc_feature (639)..(639): n is a, c, t, g, unknown, or other
  misc_feature (650)..(650): n is a, c, t, g, unknown, or other
  misc_feature (651)..(651): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacaagacgagccggcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatgggagcggtatagtggcgcgatggcggaggttgctcgccgacgctgcgactccagcgaacaactctcttgtgctggctgcggcgaggactcaccggagcgaccccttcgccaacttttacgcgtacagcggcggctggaacattagcgacgagcactactgggcttccgtgacgtacaccgcggtgcccctcttcctcatggncgtgctggggttcgtncggtttcgggnncgcatgctcgncatctcctgctgctgctggtgctcctgcggggcaggacgacccctactcgccgggtgctacttcagttcc

SEQ ID NO: 35482 - protein, 146 aa, Zea mays
  misc_feature: Ceres CLONE 1414909-F
  misc_feature (110)..(110): Xaa is any aa, unknown, or other
  misc_feature (119)..(119): Xaa is any aa, unknown, or other
  misc_feature (123)..(123): Xaa is any aa, unknown, or other
MAPASSSSAGVACLVLLLLLLLAGASAAHGSFQARRALSDDHGSGIVARWRRLLADAATPANNSLVLAAARTHRSDPFANFYAYSGGWNISDEHYWASVTYTAVPLFLMXVLGFVRFRXRMLXISCCCWCSCGAGRPLLAGCYFSS

SEQ ID NO: 35483 - DNA, 728 bp, Zea mays
  misc_feature: Ceres CLONE 1414916-F
  misc_feature: Encodes the peptide sequence at SEQ ID NO. 35484
  misc_feature (363)..(363): n is a, c, t, g, unknown, or other
  misc_feature (397)..(397): n is a, c, t, g, unknown, or other
  misc_feature (398)..(398): n is a, c, t, g, unknown, or other
  misc_feature (427)..(427): n is a, c, t, g, unknown, or other
  misc_feature (428)..(428): n is a, c, t, g, unknown, or other
  misc_feature (438)..(438): n is a, c, t, g, unknown, or other
  misc_feature (445)..(445): n is a, c, t, g, unknown, or other
  misc_feature (497)..(497): n is a, c, t, g, unknown, or other
aaagctggagctccccgcggtggcggccgctctagaactagtggatcccccgggctgcaggaattcgcacgagaccattacctagaacatcctaatcgaaaaatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctgnaagcgctcctcgacgctgacccctcccttgcccnngcgcgcacgctctacgaccgcctctccgnngctcacatcngcgccgngaatggccgcctcgaggtgctgtcaatgttctggaatcacggggtgccgccngacgttgtgatcggcaacagcaaaccccgttgatgctcccggggatgcacggaaaaccgactgggggctgaacctctgcaagccgggcccaatatctcatggtcaactcccaaacggggggaactggctggcccaaggtgcttaatgggccaaggggggtggctggggccaatccccggggggggggaaccaccgcggggaccacctggggggtccccccggtttccaaag

SEQ ID NO: 35484 - protein, 83 aa, Zea mays
  misc_feature: Ceres CLONE 1414916-F
  misc_feature (29)..(29): Xaa is any aa, unknown, or other
  misc_feature (40)..(40): Xaa is any aa, unknown, or other
  misc_feature (50)..(50): Xaa is any aa, unknown, or other
  misc_feature (54)..(54): Xaa is any aa, unknown, or other
  misc_feature (56)..(56): Xaa is any aa, unknown, or other
MGHGVSCARTGDEHDYFRAAQVGDLEALXALLDADPSLAXARTLYDRLSXAHIXAXNGRLEVLSMFWNHGVPPDVVIGNSKPR

SEQ ID NO: 35485 - DNA, 745 bp, Zea mays
  misc_feature: Ceres CLONE 1414917-F
  misc_feature: Encodes the peptide sequence at SEQ ID NO. 35486
  misc_feature (350)..(350): n is a, c, t, g, unknown, or other
  misc_feature (405)..(405): n is a, c, t, g, unknown, or other
  misc_feature (430)..(430): n is a, c, t, g, unknown, or other
  misc_feature (436)..(436): n is a, c, t, g, unknown, or other
aaagctggagctccccgcggtggcggccgctctagaactagtggatcccccgggctgcaggaattcgcacgagaccattacctagaacatcctaatcgaaaaatttttcccgttcaccgtcgcttgattttcgaatcgaatcgctcattcattcctcaccgcctccatccccgctccggcctcccctccggaagtcccaaaccctaggaaccagctgaactgccgaagctttcagaaccccaggcggcaagaacaattgcggcgagatgattctccggactccaccacagcggaagcgccgcgcaggctccggcgccggcgatgacgccgatctcggtcttgcaaatccngtgggcgtcgcgagcgcgaccggccgtagtccggtctccgatcgccgcctggccntctacgaccgccccccacgcctcgngtttgncgacgcccccgggggagccgttcgacgacatggtctgcacgtaccactgcccgcagatggtcaaatcgaattcatgttggcaactgaacccgcagaaaaagaagttccggaggtatcaaacaaaatttgtgggcctggaggacccatttacctaaaagtgaggttgaaaaaatgcagtttctggaaaaactttacttaggggaaaaaaaactggaacaaaccaaagaccggggaagggtttaaggaaccccccaaaaaggaagggggggaaaatcaaaaaaatatcgggggaaaatataaaaaaaaagg

SEQ ID NO: 35486 - protein, 122 aa, Zea mays
  misc_feature: Ceres CLONE 1414917-F
  misc_feature (47)..(47): Xaa is any aa, unknown, or other
  misc_feature (55)..(55): Xaa is any aa, unknown, or other
  misc_feature (57)..(57): Xaa is any aa, unknown, or other
MILRTPPQRKRRAGSGAGDDADLGLANPVGVASATGRSPVSDRRLAXYDRPPRLXFXDAPGGAVRRHGLHVPLPADGQIEFMLATEPAEKEVPEVSNKICGPGGPIYLKVRLKKCSFWKNFT

SEQ ID NO: 35487 - DNA, 710 bp, Zea mays
  misc_feature: Ceres CLONE 1414918-F
  misc_feature: Encodes the peptide sequence at SEQ ID NO. 35488
cacaactagtggatcccccgggctgcaggaattcgcacgagaccattacctagaacatcctaatcgaaaacgggatcgctctctctttgggctaccggctccgccgccgctccgccgccctaagtcaggtgctgaaggccttcgtcggtcttttcaccggcgacgacgacccactaggaaaagaattttcctggcatatttttgcttccagaaatattcgtgtcaagttggtatgtcagggatcacagcaatttggcgccgaacatgtccattagctgctagtcagattctaatggagacatattttggcccatctgtaatcttctggtgttctgaggtggttcagcagcggcactaaggactcaagaaaacctgaatccccctgttgctaaccatatcagggtgctggatttgcattctgcttctgcagctaattatgtgtccaacgatgagaacgtcgccccttttcatgccgaatggacactaattggacgattacttcaaagtccagacctgctgcattgccaggattcttaagcgtttgcagcttctatcggggatactcttcagatactggaatccagcaagaagtttcgagaagaggagtctctaatcttccttctacagaaagctctgcagctggacctgcaacgtgctggggtggggctcctggaatgaaaaccttgcccaatgctccgcagtctcctatg

SEQ ID NO: 35488 - protein, 78 aa, Zea mays
  misc_feature: Ceres CLONE 1414918-F
MDTNWTITSKSRPAALPGFLSVCSFYRGYSSDTGIQQEVSRRGVSNLPSTESSAAGPATCWGGAPGMKTLPNAPQSPM

SEQ ID NO: 35489 - DNA, 721 bp, Zea mays
  misc_feature: Ceres CLONE 1414923-F
  misc_feature: Encodes the peptide sequence at SEQ ID NO. 35490
caaagctggagctccccgcggtggcggccgctctagaactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggctgtgtacggactggggatcggggatccctccggaccgggataggattttcgttttgctggcgaggaagggagcttcccccgatagatgtctcacctccgataccctggatttcgtccgtggcgagtggctaccgcttctgctccttttgtgacagctgaatctttgtggttcgaaggcgattgacttgggttcactgacgcggtgacgcccaatgagctcccacgtctccacatcgcggggtcttcatcccccaggcaagcttgggacgttggactcacccggtgcgtggcagccgccagcacctatggctcagcccgaagcaggccgcggtgatgaccaggaggtcaggctggtgtcggttgcttggaatcaggactgtggatgcttcgctgccggtacagtaacggattcaggatctttaactgtgagcctttcaggagactttcaggag

SEQ ID NO: 35490 - protein, 49 aa, Zea mays
  misc_feature: Ceres CLONE 1414923-F
MAQPEAGRGDDQEVRLVSVAWNQDCGCFAAGTVTDSGSLTVSLSGDFQE

SEQ ID NO: 35491 - DNA, 755 bp, Zea mays
  misc_feature: Ceres CLONE 1414924-F
  misc_feature: Encodes the peptide sequence at SEQ ID NO. 35492
  misc_feature (561)..(561): n is a, c, t, g, unknown, or other
  misc_feature (599)..(599): n is a, c, t, g, unknown, or other
  misc_feature (609)..(609): n is a, c, t, g, unknown, or other
  misc_feature (611)..(611): n is a, c, t, g, unknown, or other
  misc_feature (613)..(613): n is a, c, t, g, unknown, or other
  misc_feature (660)..(660): n is a, c, t, g, unknown, or other
aaagctggagctccccgcggtggcggccgctctagaactagtggatcccccgggctgcaggaattcgcacgagaccattacctagaacatcctaatcgaaaaagacacacaccagagggagagggagacggagagaagggcgagcggcactagcaagcatggcggcggccgtcctagcgcccaagccgcctccttcgctgcctaccagggcctttccttcctcatccccctcgcggtttgcccctgccttcatctccccgcgtcatcccctgagaagattgctcctccgccccattccgtgcgcctcatcgccgtcttccgtcttgatgccgaacccggacctcgagactgagcctgcccacgatggagatggagatggagatgaggcgccgccggagtccaggccccgccgcatcgcccttttcgtcgagccgtctcccttcgcctacgtctccggctacaagaaccgcttccagaacttcatcaagtacctacgggagatgggcgacgaggtgattgtggtcaccacgcacgagggcgtgcctcaggaattccacggangccagctaattggctcatggagcttcccttgcccctgntatcaaaggntncngctgtcgctggccctcagtcctcgaatcatcgcagaagttgctaganttcagcctgacattattcacgccctctcacctggggatatggtatttggcgcgcttatcatagcaagttgctctgcgtccctctggtaatgtcaa

SEQ ID NO: 35492 - protein, 140 aa, Zea mays
  misc_feature: Ceres CLONE 1414924-F
  misc_feature (79)..(79): Xaa is any aa, unknown, or other
  misc_feature (91)..(91): Xaa is any aa, unknown, or other
  misc_feature (95)..(95): Xaa is any aa, unknown, or other
  misc_feature (96)..(96): Xaa is any aa, unknown, or other
  misc_feature (112)..(112): Xaa is any aa, unknown, or other
MPNPDLETEPAHDGDGDGDEAPPESRPRRIALFVEPSPFAYVSGYKNRFQNFIKYLREMGDEVIVVTTHEGVPQEFHGXQLIGSWSFPCPXYQRXXLSLALSPRIIAEVARXQPDIIHALSPGDMVFGALIIASCSASLW

SEQ ID NO: 35493 - DNA, 949 bp, Zea mays
  misc_feature: Ceres CLONE 1414931-F
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (814)..(814): n is a, c, t, g, unknown, or other
  misc_feature (860)..(860): n is a, c, t, g, unknown, or other
gcgcgccctgcgcccaatttcaaccagccccaagccnnnnnnnntcaaactggagctccccgcggtggcggccgctctagattcctggatcccccgggctgcaggaattcgcacgagaccattacctagaacatcctaatcgaaaagtctcgagccggacgacctctgaagccctagccgcctcctctctgctcggagctcctgattctgcgccatggtcgagtgagacggagaccttcgctgttgcggctgtcatctaccggctggtctcactcctcatcaacgccttctgctcgaccaaggtgatctgcctccgcgagcttatctccagatcttcggatgcgctggacaggacaggtttcggagtccctctgacagggacaacgggaagggcaggcgagggcttgttctttgagcttttccccaaagaaggggaagaacacgggttcccatgagtggggggggcccccccccacgtccaacagttccaacgctttggacacacaccgaggggaaaccccccgccccccgccgcggggcgcggagagcgaaatcctcgggaaaagcgcctccgcttgtgcggggcccctcgtagggagagccacgggggaactgagggtaaattttgaggtgggatgaggtgagtataatctagtcgccgccctccaattacggacacgcgaaaaaaaagacggttgggctgctttacccaaactggcggcctgttagaaacgcagttacgtatccataggggcgcggggttacctcccgctttggcgggagggctcccatcgtcactcaggcgccatggcgnaccccccaggcgcgagtctgagtcccccgagaggcgggggcacgcnaaccacaccgcggagcctgcccccgagtgcgacagagccgccgcggcgcgacgcgcggcgatgactccaccacccgacgccttacgggg

SEQ ID NO: 35494 - DNA, 681 bp, Zea mays
  misc_feature: Ceres CLONE 1414932-F
  misc_feature: Encodes the peptide sequence at SEQ ID NO. 35495
  misc_feature (492)..(492): n is a, c, t, g, unknown, or other
  misc_feature (500)..(500): n is a, c, t, g, unknown, or other
  misc_feature (504)..(504): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcgaaaaacaaaccgaaaaaggccgcgacgagccgacgatctctactgcccccttccggccttcggcgaccgtgacgagcaacgacgacgacggcgacgatggccgcttcctccctctgccacgggcacttgctcctgtttctcctcgtgtccgtcacatcggcctgcctcggtaccgcggcagcgcatcaagccgggtctggagagggctacacgatcgccggccgcgtcaagatcgatggcatgagtgagaagggctatggtcttccagccaagacatcaaacacaaaagtgatacttaatggcgggcaaagggttacatttgccaggccagacggctactttgcattcccacacgtggcagctggaactactgtgtttttttttaggatgcgcngtcttggntagntgggcccaatccaagttccctggggntagtgcagcaaaacagagcgattggctggccttggctctagctctggggatgactcggattcccatgggggggctgctggggggggcaaaattttgctcggagaaaattcacgggaattgcccactggagggggggggctaatattatttt

SEQ ID NO: 35495 - protein, 102 aa, Zea mays
  misc_feature: Ceres CLONE 1414932-F
  misc_feature (100)..(100): Xaa is any aa, unknown, or other
MAASSLCHGHLLLFLLVSVTSACLGTAAAHQAGSGEGYTIAGRVKIDGMSEKGYGLPAKTSNTKVILNGGQRVTFARPDGYFAFPHVAAGTTVFFFRMRXLG

SEQ ID NO: 35496 - DNA, 886 bp, Zea mays
  misc_feature: Ceres CLONE 1414934-F
  misc_feature: Encodes the peptide sequence at SEQ ID NO. 35497
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (49)..(49): n is a, c, t, g, unknown, or other
  misc_feature (886)..(886): n is a, c, t, g, unknown, or other
tttccccccccnnnnnnccacatcccatccccccctcctctccactttntcaaagctggtgctccaccgcggtggcggccgctctagaactagtggatcccccgggctgcaggaattcgcacgagaccattacctagaacatcctaatcgaaaacttctgccattccgccgaacaccttccccaatcgtgcgcctccggccatgggggaagcctccgacgccgcggtagccgtatctgcgcggctcctgcagatggcggacgaagacgactctgtagtgctcggtgacccccctgccccacccccgcctcttgctcacgatcccgctccgtgctactctctcgcgcacgtagagaaacctatgaccccggtaatgatctactgccccactaagatcccgtggtcctcgaacccactaacccacttcatctccgcccccacccagacccgatccccaaccgccggccaccggcgaccccgcccctctgccacccgccaccacccctctttgccaagcccgggacgacccggcccgccttccccctttgtcctacttagcttggcgtcagcaatacctcgcgatcctcccctaaaatatagaatggtccgctccgaacccccaacctttctacccccctaaccaatatgatccaatatgtgccagaacccgtcaccgtacgcacacccctcatacctttatccccacctcaaaccttaatccctccagcctaaagacaccacccaccctttatctccaccacttcgcctcgcgacacagccgaagatgtggaaaggaacgcatcccgcgtatccgctcgagcaacccacgggatcatatcatgaaagagggtacactaataacgcacacagcaagcacccttaccgan

SEQ ID NO: 35497 - protein, 34 aa, Zea mays
  misc_feature: Ceres CLONE 1414934-F
MWKGTHPAYPLEQPTGSYHERGYTNNAHSKHPYR

SEQ ID NO: 35498 - DNA, 738 bp, Zea mays
  misc_feature: Ceres CLONE 1414935-F
  misc_feature: Encodes the peptide sequence at SEQ ID NO. 35499
  misc_feature (522)..(522): n is a, c, t, g, unknown, or other
  misc_feature (554)..(554): n is a, c, t, g, unknown, or other
  misc_feature (607)..(607): n is a, c, t, g, unknown, or other
  misc_feature (738)..(738): n is a, c, t, g, unknown, or other
aagctggagctccccgcggtggcggccgctctagaactagtggatcccccgggctgcaggaattcgcacgagaccattacctagaacatcctaatcgaaaactgttttgttctccttctcattcgactctgatgatgacgagacggttatcgttccccttctggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggcaagggcggtgcgagaagaggtacgtgccgtcggtcacgtcggcgctaatagtcggttccattctcggnctgcttcaggccgtcttcctggtcctttcggncagattcgtgctcaacatcatgggtgttaagtccggatccccgatgcaagggnctgcggtgcgctaccctaacgataggtcccttggtgcccccgctgtgctgctgtctctggccatgcaaggggttttccgggggttcaaggacaccaagacaccgttatacgctactgtgggtggcgacgcn

SEQ ID NO: 35499 - protein, 115 aa, Zea mays
  misc_feature: Ceres CLONE 1414935-F
  misc_feature: The sequence is a functional homolog of SEQ ID NO 6 in US patent 7189891
  misc_feature: The sequence is a functional homolog of SEQ ID NO 3 in US patent 7189891
  misc_feature: The sequence is a functional homolog of SEQ ID NO 9 in US patent 7189891
  misc_feature (54)..(54): Xaa is any aa, unknown, or other
  misc_feature (72)..(72): Xaa is any aa, unknown, or other
MAECVNSCIPTECAADPSGRQGRCEKRYVPSVTSALIVGSILGLLQAVFLVLSXRFVLNIMGVKSGSPMQGXAVRYPNDRSLGAPAVLLSLAMQGVFRGFKDTKTPLYATVGGDA

SEQ ID NO: 35500 - DNA, 674 bp, Zea mays
  misc_feature: Ceres CLONE 1414938-F
  misc_feature: Translation starting site: 228
  misc_feature: SWISSPROT Homolog: EC 2.1.1.125 Histone-arginine N-methyltransferase
aaaagctggagctcaccgcggtggcggccgctctattaatagaggatcccccgggctgcaggaattcgcaggagaccattacctataacatcctaaaaaactcaaacccgtaatcactagccacaccaagtcctcttccctccttccccgttggcttcggtggaggagggccatcgccaaccagtatcgaacggaggagaagcgctgtttacgcccgtctgggaggaatgccgctgcgggattgtgcggaggacgagagagactcccgctactgcggaggggaggttctcgacttccccggcggggagggtctccgtgacggccacaatcactccctcgcctgcggcttcaaatcgtcctcgcccctctgggtgatcccaactagcggccggtggccggagccggtctgccatggccagcgccagaactcgtcctcaacccgtcccggagttagaaccaggtcgaggagaggatcagcgagtggatcgacttgaacgcggaggacgagcggctccggttggactccgagatcacggtgaaacaggagatcgcttgaggatctcacgtctcgtggcatgcatgtgtaatgccggcccgcacgagatctttttgcggtactgatgtcagagcagagaagcaaagtttgaaaggcctgaaccacatgaatttgtggg

SEQ ID NO: 35501 - DNA, 728 bp, Zea mays
  misc_feature: Ceres CLONE 1414941-F
  misc_feature: Encodes the peptide sequence at SEQ ID NO. 35502
  misc_feature (410)..(410): n is a, c, t, g, unknown, or other
  misc_feature (422)..(422): n is a, c, t, g, unknown, or other
  misc_feature (423)..(423): n is a, c, t, g, unknown, or other
  misc_feature (426)..(426): n is a, c, t, g, unknown, or other
  misc_feature (440)..(440): n is a, c, t, g, unknown, or other
caaagctggagctccccgcggtggcggccgctctagaactagtggatcccccgggctgcaggaattcgcacgagaccattacctagaacatcctaatcgaaaagaagcatctcttctccccccttcccaatcgggctgcggcatatccccttctccgtcctcccgcctgccgccatgtcttcgccttcgccctcgccgccggcgccggcggaagaggagggccgggcgccgaccaagtacgtgctgatcaccggcggcgtcgtcagcggcctcggcaagggcgtcaccgccagcagcatcggcgtcgtcctcaaggcctgcgggctccgcgtcacttgcatcaagatcgatccatacttgaacacagatgctggtacaatgtccccctttgagcatggcgaggtgtttgntcttgatgatgnntgnagaaggtgacttgnatttggggaaatatgagcgtttcatagatggtactctgacaagggataacacattaccactggaaagatatacagtctggcattgaaaagaaaagaagggtgattatctggaaaagactgaacaggtattcccatggaccgaggaaaaaaaaagggaaaacgccagggcttcgggtccctgggaatggcaaaaccccccaaggaagggttggggaattaaattggggggccctgaagggtaattgagcccagcccttttttgaattttgggccaaatacctttttttt

SEQ ID NO: 35502 - protein, 86 aa, Zea mays
  misc_feature: Ceres CLONE 1414941-F
  misc_feature (20)..(87): Pfam Name: CTP_synth_N Pfam Description: CTP synthase N-terminus
  misc_feature: SWISSPROT Homolog: EC 6.3.4.2 CTP synthase
  misc_feature (79)..(79): Xaa is any aa, unknown, or other
  misc_feature (83)..(83): Xaa is any aa, unknown, or other
  misc_feature (84)..(84): Xaa is any aa, unknown, or other
MSSPSPSPPAPAEEEGRAPTKYVLITGGVVSGLGKGVTASSIGVVLKACGLRVTCIKIDPYLNTDAGTMSPFEHGEVFXLDDXXRR

SEQ ID NO: 35503 - DNA, 757 bp, Zea mays
  misc_feature: Ceres CLONE 1414948-F
  misc_feature: Encodes the peptide sequence at SEQ ID NO. 35504
  misc_feature (653)..(653): n is a, c, t, g, unknown, or other
  misc_feature (740)..(740): n is a, c, t, g, unknown, or other
aaagctggagctccccgcggtggcggccgctctagaactagtggatcccccgggctgcaggaattcgcacgagaccattacctagaacatcctaatcgaaaaacaagctcctcctcctctcctccctacacactccagagccagaggcagcacgtgctgccgtgctcgagcacagctaggccgcagctgcatcaccatggcgggcgcgccgctgcggagatcggaccttgacttcgccgacgtctttggcggcccgccgcgccgcgtgtctgggaacgagcaccgctcgcagcgcggctcgcaggacacctcgtcgttcgagtccgcgacgagggcggggagcggcggaccggacacgcccgttttcggggaccgggggagctccgaccgaagaaggcagctcggggaggagttctacaaggacatattccccgggagcgaggcagcgtcgcccaggcggagcggcgccggggattgggggaatgtgttcggcgcgcaggcttcgcctgtctccacggcccgcccgcgatcgagcttctccattcggttcaacagaggcatggacagttcaatgcctacttctccctctcagcaaatggtccacagaaacgatgatggcacatcttatgcttataggtgtcccacttcacccnatgcatccatgaaacaatatcttgctcaaggggcagcccccgacagatcgaagaagatcccctctcatggcatcgctatccatttcntatctaggtccgttccc

SEQ ID NO: 35504 - protein, 187 aa, Zea mays
  misc_feature: Ceres CLONE 1414948-F
  misc_feature (153)..(153): Xaa is any aa, unknown, or other
  misc_feature (182)..(182): Xaa is any aa, unknown, or other
MAGAPLRRSDLDFADVFGGPPRRVSGNEHRSQRGSQDTSSFESATRAGSGGPDTPVFGDRGSSDRRRQLGEEFYKDIFPGSEAASPRRSGAGDWGNVFGAQASPVSTARPRSSFSIRFNRGMDSSMPTSPSQQMVHRNDDGTSYAYRCPTSPXASMKQYLAQGAAPDRSKKIPSHGIAIHFXSRSVP

SEQ ID NO: 35505 - DNA, 669 bp, Zea mays
  misc_feature: Ceres CLONE 1414949-F
  misc_feature: Encodes the peptide sequence at SEQ ID NO. 35506
  misc_feature (669)..(669): n is a, c, t, g, unknown, or other
ggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagccccgctcgctccccgtcatcgtcacctacagggccgaattggggagggaggccagtacgcaggcgaagatgagccacggtttgaggn

SEQ ID NO: 35506 - protein, 95 aa, Zea mays
  misc_feature: Ceres CLONE 1414949-F
MATAASSTPAARQPTLVCASLTARVPREMAAEVAAAAALGADVAELQVGCLDSFEPCRDLPVLLAQPRSLPVIVTYRAELGREASTQAKMSHGLR

SEQ ID NO: 35507 - DNA, 740 bp, Zea mays
  misc_feature: Ceres CLONE 1414956-F
  misc_feature: Encodes the peptide sequence at SEQ ID NO. 35508
  misc_feature (410)..(410): n is a, c, t, g, unknown, or other
  misc_feature (430)..(430): n is a, c, t, g, unknown, or other
  misc_feature (492)..(492): n is a, c, t, g, unknown, or other
  misc_feature (498)..(498): n is a, c, t, g, unknown, or other
  misc_feature (499)..(499): n is a, c, t, g, unknown, or other
  misc_feature (540)..(540): n is a, c, t, g, unknown, or other
  misc_feature (740)..(740): n is a, c, t, g, unknown, or other
caagctggagctccccgcggtggcggccgctctagaactagtggatcccccgggctgcaggaattcgcacgagaccattacctagaacatcctaatggaaaaatgcccgactaacccgtggactctctcagctccgaagcgcccgacccgccaccacatccctgatggctgccctcgccaacatcgagtcctcggcacttccgccgtccgactcatccgaaggtaatggcaagatggacaaggaggaagaggacgatgcgaacggtgcgtagaagatgtgcggcatctgctatgtcgacgagcggggggaccatccgcgccgaggtcgactgctgcgccaattccttttggttcacctccatcatggtattggggtcggagtcacgtccaccccgtcacttcttcgaggngtctggtttttgcgccaatncggcggccctggcctgcggcccggggggatcccctgacaacgaaactagcgcccgaacgtcnaaaggnnacaccgaggacacccactctctgggggacaagggcgagcgnctcccaccggcgcgagaaattctataagggggaacgacttttcacccgcgtgtgagacccaacccaccgctataaaagcatccacgtcttcctcggagaaggctccaacctcggaggcacaaccatcacgcgcgtgcacagggcccacccacggtcaccagaagtcaacgtgccaccgaaccagtgcgcgccccacccgn

SEQ ID NO: 35508 - protein, 113 aa, Zea mays
  misc_feature: Ceres CLONE 1414956-F
  misc_feature (62)..(62): Xaa is any aa, unknown, or other
  misc_feature (69)..(69): Xaa is any aa, unknown, or other
  misc_feature (92)..(92): Xaa is any aa, unknown, or other
MARWTRRKRTMRTVRRRCAASAMSTSGGTIRAEVDCCANSFWFTSIMVLGSESRPPRHFFEXSGFCANXAALACGPGGSPDNETSARTSKGXTEDTHSLGDKGERLPPAREIL

SEQ ID NO: 35509 - DNA, 666 bp, Zea mays
  misc_feature: Ceres CLONE 1414957-F
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (29)..(29): n is a, c, t, g, unknown, or other
  misc_feature (173)..(173): n is a, c, t, g, unknown, or other
  misc_feature (184)..(184): n is a, c, t, g, unknown, or other
  misc_feature (208)..(208): n is a, c, t, g, unknown, or other
  misc_feature (211)..(211): n is a, c, t, g, unknown, or other
  misc_feature (246)..(246): n is a, c, t, g, unknown, or other
aaaagctgggagctccaccgnncggtgnngcggccggctcctagaactagtggatcccccgggctgcaggaattcgcacgagaccattacctagaacatcctaatcgaaaaagccgccacctcaccccccccatcggccgcctgcgtcccaccacccgctcctgctgccgggnctgccgcccgntgctctcgacactgaagccctcgncgncgcctccgcctccgaccgttagcttgccctcctgncggctgcctccccgatgaaaaacggccccaacctggccaacggaaacgggggcccccctgaaccttccccggggttttcccccgaaaaaaaatccccggaaaataaaagccatgggggtcccctggaagccccggaaaaaagcccccccgggaaattttgggaaacccccctaaaaaaaggcccccaaaaaaacaaaaagttccccaaagaagtgaaaaaaaatgggggtttttttgggggggaaaaaaaaaatccgggtgggagaaacccccaaaaaagaaaaatttttcccctccacaaacagaggggggggggggttttttaaaaacccccccccccccccccccttgggggagaaaaaacccattggaggaaaaaaacccccccccttttctaagggggggggataaacaaaaaaa

SEQ ID NO: 35510 - DNA, 753 bp, Zea mays
  misc_feature: Ceres CLONE 1414960-F
  misc_feature: Encodes the peptide sequence at SEQ ID NO. 35511
  misc_feature (712)..(712): n is a, c, t, g, unknown, or other
  misc_feature (753)..(753): n is a, c, t, g, unknown, or other
aaagctggagctccccgcggtggcggccgctctagaactagtggatcccccgggctgcaggaattcgcacgagaccattacctagaacatcctaatcgaaaagaatacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggccatcgtgggcgtccgcgcgccgccgcgtggccgtgcctgggccggcctcgagaagccgccgcgcgccgcttgccgcgccagagtcccgacggcgaggctcgcggtcgcggcggacaggccgcggaggctggtgctgctgggcgccgatacgcggagggccgcggatcctgccctccgttgcgccgcgcaatctgcaggtggaacaggaaaggtccactactctgctgatgacgctctcatactacaggttaggaaaatatgcaccaccccacccccacccaataggaactgatgaattgctaatttctttgtaggagaaaatatatcaaacagctatagctatttatatggtgnatatatattactaatatgacggacatgttaaaactccagan

SEQ ID NO: 35511 - protein, 99 aa, Zea mays
  misc_feature: Ceres CLONE 1414960-F
MEAIVGVRAPPRGRAWAGLEKPPRAACRARVPTARLAVAADRPRRLVLLGADTRRAADPALRCAAQSAGGTGKVHYSADDALILQVRKICTTPPPPNRN

SEQ ID NO: 35512 - DNA, 727 bp, Zea mays
  misc_feature: Ceres CLONE 1414961-F
  misc_feature: Encodes the peptide sequence at SEQ ID NO. 35513
  misc_feature (596)..(596): n is a, c, t, g, unknown, or other
  misc_feature (597)..(597): n is a, c, t, g, unknown, or other
  misc_feature (607)..(607): n is a, c, t, g, unknown, or other
  misc_feature (727)..(727): n is a, c, t, g, unknown, or other
aaagctggagctccccgcggtggcggccgctctagaactagtggatcccccgggctgcaggaattcgcacgagaccattacctagaacatcctaatcgaaaaaaaaatatgataacacatcaattgccagtcgtcgtccccaccgctggccgcgcggaagcccgcgaagatgtccctcggcgggaccagcggcccgcgcgtctgcgcccggatctgcaagctcgccggacgccgccagcggatgctcctccgcctcctcgtctccgtcgccgtggcattctgcttcctcttctcatcacttgtcagtaaagacgaagatgcatcacctggtgttgagaccatgcttgtgttttctgatcatgtccggagctttgtgaaccctgtttggacatcgtcaggcagaccagttgatagaaaacgcactggaccacgaccttgtccagtttgttatttgccagttgagcaagcactggcactgagaccagctaaaccatcattgtcaccagtccttcaaagcttaaattatgttcttgaagagattttgattcctaaagagtccaagagcggttctttgtttggaggttttccatccctgnnagaacgagantagtcttatgacataaaagactcgatgagtgtacattgtggatttgtaagagggaaggtacctggtcttaatactgggtttgacatagatgaagctgatcattctgagatgcagctgtgn

SEQ ID NO: 35513 - protein, 145 aa, Zea mays
  misc_feature: Ceres CLONE 1414961-F
  misc_feature (143)..(143): Xaa is any aa, unknown, or other
MSLGGTSGPRVCARICKLAGRRQRMLLRLLVSVAVAFCFLFSSLVSKDEDASPGVETMLVFSDHVRSFVNPVWTSSGRPVDRKRTGPRPCPVCYLPVEQALALRPAKPSLSPVLQSLNYVLEEILIPKESKSGSLFGGFPSLXER

SEQ ID NO: 35514 - DNA, 689 bp, Zea mays
  misc_feature: Ceres CLONE 1414966-F
  misc_feature: Encodes the peptide sequence at SEQ ID NO. 35515
  misc_feature (637)..(637): n is a, c, t, g, unknown, or other
aagctggagctccccgcggtggcggccgctctagaactagtggatcccccgggctgcaggaattcgcacgagaccattacctagaacatcctaatcgaaaagtgttgccaaagttatcgttgtcttctctagcgacggcgaggcttgagcgctcacgtccaggcgttcccgtgccggtggccaagccagcagccgacgagatggactacctcaggacggtggttccgtcacaactcttggcagagcgcggctccaatcttgtcgtcatcaacccaggatcgggaaatgtgcgaatggggtttgctagtcaggatgtgccattcaatataccacattgcattgcccgacacatcaatccacaagagggcgaagaaccaagattctctgtgcgcaatcagatgctcaactggcatgctacttcatcgcagaatgcagagcgggagagtgcatatgatattattgcagcactgatgaaaacccatttttggacgatgaagaaatgccttcaccgaaacaccccttccctcaagatgggacggggtgatggcttcccctcccagcaaaacagaaacgataattaattcccttggacggattggtccaaaggaatttttaagccctcccccccttcgaaaancacgtataaagggaggctgggaaaaaaccctggccaagccctctgggtggga

SEQ ID NO: 35515 - protein, 126 aa, Zea mays
  misc_feature: Ceres CLONE 1414966-F
MDYLRTVVPSQLLAERGSNLVVINPGSGNVRMGFASQDVPFNIPHCIARHINPQEGEEPRFSVRNQMLNWHATSSQNAERESAYDIIAALMKTHFWTMKKCLHRNTPSLKMGRGDGFPSQQNRNDN

SEQ ID NO: 35516 - DNA, 713 bp, Zea mays
  misc_feature: Ceres CLONE 1414967-F
  misc_feature: Encodes the peptide sequence at SEQ ID NO. 35517
aaagctggagctccccgcggtggcggccgctctagaactagtggatcccccgggctgcaggaattcgcacgagaccattacctagaacatcctaatcgaaaagaaaagcccattccgctcatcactgaacaacccccggcggcaaccctccccacagatggccggcgaacccagcgccgccgtggcatcggggcccgaatccgcggccgaggccgaccgcctcctggcgctggccgagtcggagctctccgcgggcaggctccgagccgcgcgcaggcacgccctccgcgccgcccgcctgtacccgacctccccgcgcgccccggtggtggccaccgccgccaacgtgctcctcgccgacgactcctcccaccacgccgcgctgctgctgcccgaacccgacgaccccgacgcctcggcgatctccgcctccgagttccggcgccacttcaagtcgctcgtcaagtccctccgcgtcgggctccgaggcggcaccggaatcgcttaccccttccgtttccgccggcgccggaggaagacctccgccgcggccaccgaggcctacaaaggggtttaccggcccccggccctgggaaccttttgggaccgccctgggccggggggcccccctccccccccaaattccaaccccaaaaatttgggaagaaacccccccccccggggcacttcctggggggggaaacctttttttg

SEQ ID NO: 35517 - protein, 185 aa, Zea mays
  misc_feature: Ceres CLONE 1414967-F
MAGEPSAAVASGPESAAEADRLLALAESELSAGRLRAARRHALRAARLYPTSPRAPVVATAANVLLADDSSHHAALLLPEPDDPDASAISASEFRRHFKSLVKSLRVGLRGGTGIAYPFRFRRRRRKTSAAATEAYKGVYRPPALGTFWDRPGPGGPPPPPNSNPKNLGRNPPPRGTSWGGKPFF

SEQ ID NO: 35518 - DNA, 740 bp, Zea mays
  misc_feature: Ceres CLONE 1414978-F
  misc_feature: Encodes the peptide sequence at SEQ ID NO. 35519
  misc_feature (493)..(493): n is a, c, t, g, unknown, or other
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaagattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatccgatagcattgtggatctggaggtaggaaaagggcttggtggtagacgtggaggacgatggcgttcatggtcctagaagtaagcgcgatggtctcctcnagcatcggcttcgtggacggctggttcttcccatcatagatcagaagaagactcgagtcataaaaaaagtcatcatttgtgcttgaatcccacgaaatggccgctggttcttctcatttcgttgtagcatgcctagatctgtgaaatgttttgtttctttcgcttcggctgaatcccacgagnagctggcgggatctagtttccaatacatacaaaagttttttggggggattgataatgtggaatc

SEQ ID NO: 35519 - protein, 54 aa, Zea mays; identical to SEQ ID NO: 24650
  misc_feature: Ceres CLONE 1414978-F

SEQ ID NO: 35520 - DNA, 828 bp, Zea mays
  misc_feature: Ceres CLONE 1414981-F
  misc_feature: Encodes the peptide sequence at SEQ ID NO. 35521
  misc_feature (35)..(35): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (71)..(71): n is a, c, t, g, unknown, or other
ggccgccccccctcccccgccccacataatttagntggggnnnnttcaaagctgggactccccgcgggggngggcgctcttcaactagtggatcccccgggctgcaggaattcgcacgagaccattacctagaacatcctaatcaaaaaatccgctccccgccttccgcttccctaccccccgcatcacctaccaacgccgagatcatgggggccttcgcgaatgaggagcaccaggtcctcgccgagctcggcctcgcgcagcgcaacccgggcgcgttcgcatgcggtgcgaggggcggatcaggtgccaacgtcacctacacgagcccgaccaacaatcatgtcatcgtagaggcggcggaggcgcccgtgcaagactaccaggaggccatgcgcgcctgcttcgacggcgttaagaaatggatggggattcctgcgccaaagcgaggagagatcgtcatccaaatccgcgatgcactgagaacaaagctccatcacccttgccgggctcgcgcccccttgagaagggagaaaaatgcttccccgaaggggaaccggggaggcccaaggaaaatacaatggatatggcgtggtttatcgctggggggaaccaagggctaccaactgttcgggagagacatttagccgatctgggaccgagcaaaaccattaacgaagaatgagggggcgtaggacaacccccctccggagtatggggggcgggatataaaccgggaatagaaagatccccatagagcttgcggactcgggttgagaaatgagttgccactcggctgtgtgtctcccgggaaaacatgggttcccg

SEQ ID NO: 35521 - protein, 146 aa, Zea mays
  misc_feature: Ceres CLONE 1414981-F
  misc_feature: SWISSPROT Homolog: EC 1.2.1.3 Aldehyde dehydrogenase (NAD(+))
MGAFANEEHQVLAELGLAQRNPGAFACGARGGSGANVTYTSPTNNHVIVEAAEAPVQDYQEAMRACFDGVKKWMGIPAPKRGEIVIQIRDALRTKLHHPCRARAPLRREKNASPKGNRGGPRKIQWIWRGLSLGGTKGYQLFGRDI

SEQ ID NO: 35522 - DNA, 702 bp, Zea mays
  misc_feature: Ceres CLONE 1414982-F
  misc_feature: Encodes the peptide sequence at SEQ ID NO. 35523
  misc_feature (308)..(308): n is a, c, t, g, unknown, or other
  misc_feature (502)..(502): n is a, c, t, g, unknown, or other
aaagctggagctccccgcggtggcggccgctctagaactagtggatcccccgggctgcaggaattcgcacgagaccattacctagaacatcctaatcgaaaaacttctcgttctcgccgatccagtgccactacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatccgagaagcgccgcgagatggccggnggcggaggcggcggtgccgcgccgaagcacgacgacttcacgccgcaccccgtcgaggaccagctccctggggtctcctactgcatcaccagcccctccccgtagactgaaagcgttcttcttgggttcccacattatctggccatgcttgggaccactgtgatcataccaactgcacttggtccacaaatggnaggcaaccatggaggcaaagccaggggttatccagacttggctgggccgtgcaaggaaccaccccctcctgaaaggttctttggaaacaatgttcccgcaaggaatcgcgggtcaaaaacctttgggcggccaaccatttcgaaatcccttgcgggaagttttgttaggaccccacccccatataaaattttcccccaag

SEQ ID NO: 35523 - protein, 37 aa, Zea mays
  misc_feature: Ceres CLONE 1414982-F
MAGGGGGGAAPKHDDFTPHPVEDQLPGVSYCITSPSP

SEQ ID NO: 35524 - DNA, 767 bp, Zea mays
  misc_feature: Ceres CLONE 1414993-F
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
ggggccccccccccnaannnnantcaataaaaacaacatccgccttttttttcccagctggagctccaccgcggtggcggccgctctagaactagtggatcccccgggctgcaggaattcgcacgagaccattacctagaacatcctaatcgaaaagacgagacggttatcgttccccttctggccgaatcgttattatcagtgggctagaacatactaatgcgagtgctgtgctgctaaatctaatctgcgtgcgattggtcgatggtcaggttcggtgtagatcgacgcgggtggcatttcgatcgccatatttaaccaagcctccaaggtctgcatctaccctcgcgttagcgtcacaacgttacttcgtcgcggaggaagacgcgatcatcaggaagggcgtccgaggaaacagcattcaggaggaggacgcgcagaaagcctcccccgtgggctttgatccggagaccagcaatctgcatgcatctggccctgctggtcctggtagaacgcgtgaacctcgcgcatccccaccgcagtggcgaacagatcccctttggcacgacaacggcgggcgccaaaaataaccacgtggccgtccggccacaatcggcgtctaatagtagggcagtatttctgaggtctggcttagggccggtttttcctggggtgttttcggttctaattccgtggttaacctgcgtggtggggttacctccgcgagcccccgaatgccccgccacctggccgccccgcacaccccg

SEQ ID NO: 35525 - DNA, 755 bp, Zea mays
  misc_feature: Ceres CLONE 1414998-F
  misc_feature (36)..(36): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (678)..(678): n is a, c, t, g, unknown, or other
gagcccccccccccccccccccccccccccgaccgnttnccccnnnnacaaactgagactccccgcggtggcggccgctctataatagtggatcccccgggctgcaggaattcgcacgagaccattacctagaacatcctaatcgaaaaagtgctggatagccatacatgcatcgatccctagctctttgcttgccgaggatttctcctgctcatacaacacaagccatgaggggtttccagctgctactcatcatagtggcattgcttgccggggagttgcactgcgcaagagcagcatcagcagcagatgcaccggaggctgcaccacagtcccccgaagcaccaacagcacatgagcaaacgccaccgcaggcgcctgggtcaacatcaccacctccacctccacgacgtcggggatctccacatcgacggccacccagaccgacggatcagcatgatccaccaccgccaaggttggtcgtgtcaacacatgaacctcctgtaccggcaccacctgcaatgacgatcaaccgaaataacggcttggaccacactccttggtacttggagacttccaccgtggcaccctggaaaaaaaaaaccatctggcccccaccagccaagggcaaatttccttgcccctaccggattgaaacttcctaacggatcgcaccgnacaaactgtgtccgaatccccaaaagcggcccggtatcatcacaccagatatggccacgccgtgagaaaccctaact

SEQ ID NO: 35526 - DNA, 572 bp, Zea mays
  misc_feature: Ceres CLONE 1415003-F
  misc_feature: Encodes the peptide sequence at SEQ ID NO. 35527
  misc_feature (458)..(458): n is a, c, t, g, unknown, or other
  misc_feature (462)..(462): n is a, c, t, g, unknown, or other
  misc_feature (470)..(470): n is a, c, t, g, unknown, or other
aagctggagctccccgcggtggcggccgctctagaactagtggatcccccgggctgcaggaattcgcacgagaccattacctagaacatcctaatcgaaaaacacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatggtgagccccctcgaaatcccacaaagggactggttcccctctgacttcaccttcggtgcccgcacttcagcgtaccaaattgaaggtgcttggaaatgaanaggnaaaggggnaaagcaacctgggatcccttcctgccaaaatcttcccgaaagggataactggacggggaagcaattccaacctttggagacggaattccccacccacatagt

SEQ ID NO: 35527 - protein, 33 aa, Zea mays
  misc_feature: Ceres CLONE 1415003-F
  misc_feature: SWISSPROT Homolog: EC 3.2.1.21 Beta-glucosidase
MVSPLEIPQRDWFPSDFTFGARTSAYQIEGAWK

SEQ ID NO: 35528 - DNA, 690 bp, Zea mays
  misc_feature: Ceres CLONE 1415010-F
  misc_feature: Encodes the peptide sequence at SEQ ID NO. 35529
  misc_feature (690)..(690): n is a, c, t, g, unknown, or other
agagctggagctccccgcggtggcggccgctctataactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaacaacaatcaggtcatcgcagaggtcgtggaggcgtccgtgcacgactacgaggaggggatgcgcggctgcttcgatggcgcccagaaatggatgggggatcctggctccaaaggaggagagatcgttagggaaatcggggatgccctgaaagcaaagcctcatcaccttggccagggttggggccccttgagaagggggaaaaatcttcctggaagggatccggggaggttcaaggaaaacaccgaaatggggggattatggctggggggggttaagtcgcccaaactaaaagggatcccttttaatcccctcctgaaacggaccaaaccatatgatggggtgggggaggggggggaacccccctgtgaagaatgtgtgggggggggttattaaagggggttn

SEQ ID NO: 35529 - protein, 173 aa, Zea mays
  misc_feature: Ceres CLONE 1415010-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPNNNQVIAEVVEASVHDYEEGMRGCFDGAQKWMGDPGSKGGEIVREIGDALKAKPHHLGQGWGPLRRGKNLPGRDPGRFKENTEMGGLWLGGVKSPKLKGIPFNPLLKRTKPYDGVGEGGEPPCEECVGGGY

SEQ ID NO: 35530 - DNA, 670 bp, Zea mays
  misc_feature: Ceres CLONE 1415011-F
  misc_feature: Encodes the peptide sequence at SEQ ID NO. 35531
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcactgtgagcttttcgatttcgttgccgtattttcacgaaatcgggttccgaagttgtttctgtgtgtttttcatcaaattgctaatcgtgttgtgcatttttcatgtacattttgttattgtatatgaaattaggttgtcgttaagctgttacttagccacaaccacaatgaan

SEQ ID NO: 35531 - protein, 147 aa, Zea mays; identical to SEQ ID NO: 16668
  misc_feature: Ceres CLONE 1415011-F

SEQ ID NO: 35532 - DNA, 645 bp, Zea mays
  misc_feature: Ceres CLONE 1415013-F
  misc_feature: Encodes the peptide sequence at SEQ ID NO. 35533
  misc_feature (313)..(313): n is a, c, t, g, unknown, or other
  misc_feature (390)..(390): n is a, c, t, g, unknown, or other
  misc_feature (430)..(430): n is a, c, t, g, unknown, or other
  misc_feature (437)..(437): n is a, c, t, g, unknown, or other
  misc_feature (477)..(477): n is a, c, t, g, unknown, or other
aagctggagctccccgcggtggcggccgctctagaactagtggatcccccgggctgcaggaattcgcacgagaccattacctagaacatcctaatcgaaaaactcccaccgtatcctcccctgcgtagggtttaaccactcgcagcagccgccgtgactcgagaatcatgtcagcgccgccgtcgctcaagaccccggcaaccgccgtagcggtctctcggcgctcggtcgccaccccgagagccaccgggcttcgcggcgcctgtgctcccccgactcggcgcctccggtgctcagcctccgccgccgtggncggggcttccaccgagatggctgatgctccgctggactgggcagagaggtcgctggagggagtacgcagcttggccngacacgacacgttctgcttgatggcgctctcgccgctggnacggcgntacgatcgcttcgtcaaggagctgatgccctttttcagcnggagtcggctaatcagataccgcgttctcatcgagataaggggctactgaaactttctcaaaatcctgaaatccttgagggggctccattcagaaaggaacgcgcagcccttgttgaatgccttttttggaaaatttttggctaaaggggggcaaaaaaaattaaaaa

SEQ ID NO: 35533 - protein, 65 aa, Zea mays
  misc_feature: Ceres CLONE 1415013-F
  misc_feature (21)..(21): Xaa is any aa, unknown, or other
  misc_feature (34)..(34): Xaa is any aa, unknown, or other
  misc_feature (50)..(50): Xaa is any aa, unknown, or other
MADAPLDWAERSLEGVRSLAXHDTFCLMALSPLXRRYDRFVKELMPFFSXSRLIRYRVLIEIRGY

SEQ ID NO: 35534 - DNA, 767 bp, Zea mays
  misc_feature: Ceres CLONE 1415016-F
  misc_feature: Encodes the peptide sequence at SEQ ID NO. 35535
  misc_feature (1)..(1): n is a, c, t, g, unknown, or other
  misc_feature (767)..(767): n is a, c, t, g, unknown, or other
nttttcccccttttctttttctccaccctctcccttccccgcacctctcctctccaaagctggagctccccgcggtggcggccgctctataactagtggatcccccgggctgcaggaattcgcacgagaccattacctagaacatcctaatcgaaaaaatataatggtattacccccgtcgtcaaatgcaccgccacccaaccccatggccgccgccaccggaagaaccatgaagacgatggcgctcgtcgtcgtcctcgccgccctcctctgctccatctcggtcgccgctgcagccagcggcggcctttcttcgtacgtggtgtacctcggccagcacgcgcacggcgcggcgctgggcacgcacggcgccgaggagctgcaggcgctggagcgcgacgccgccgaggcgcactgcgacctcctcgccggcgtcttgggcggagacaagcagaaggcgcgggaggcgatcttctactcgtacacgaagaacatcaacggcttcgcagccaacctggacgccgccaccgccgccgagattgcgggaaaacccggggtgatctctgtgttccccacccaggcccgcaagctgcacacgacccgggtcatgggaagttcgtccggcccgggccagggccccggcgggcgtccccccacggcggagtcagtgtcggaaaaggcccaaggtccgggtcgccgaaccccattcattcgggcaacctttcccaaacctggggggtgggggcgccggcaaatcccgaagaagn

SEQ ID NO: 35535 - protein, 187 aa, Zea mays
  misc_feature: Ceres CLONE 1415016-F
  misc_feature (36)..(130): Pfam Name: Subtilisin_N Pfam Description: Subtilisin N-terminal Region
  misc_feature: SWISSPROT Homolog: EC 3.4.21.25 Cucumisin
MAAATGRTMKTMALVVVLAALLCSISVAAAASGGLSSYVVYLGQHAHGAALGTHGAEELQALERDAAEAHCDLLAGVLGGDKQKAREAIFYSYTKNINGFAANLDAATAAEIAGKPGVISVFPTQARKLHTTRVMGSSSGPGQGPGGRPPTAESVSEKAQGPGRRTPFIRATFPKPGGWGRRQIPKK

SEQ ID NO: 35536 - DNA, 685 bp, Zea mays
  misc_feature: Ceres CLONE 1415017-F
  misc_feature: Encodes the peptide sequence at SEQ ID NO. 35537
  misc_feature (566)..(566): n is a, c, t, g, unknown, or other
aaaagtggagctccccgcggtggcggccgctctagaactagtggatcccccgggctgcaggaattcgcacgagaccattacctagaacatcctaatcgaaaatggagaaatctggacagaatgctcatatattgttgtctatgttagtcaagcatcttgaacacaagaatgtattgaaacaaccagatatgaatctagatatcattgaagttacttcacgccttgctgaacactccaaagctcagtcttctatagcactaatgtcttcaataagtgatatggtcaggcatatgggtaaaagcatgcaatccttggccagtgatgcaggtcctggagacaacatggtcaaatggaatagcagatatgggaaagctgtagatgaatgtcttgttcagttgtctagaaaggtcggtgatgctggacctatccttgatacgttagctgtagtactggaaaatatttcgagttctatgattgttgcacggtctactatctctgcagcatatcgcactgctcaaatagttgcatcattgccaaacttgtcacatcagagcaaagcatttccntgaggcgttgtttcatcaacttcttttagcaatgctctatccagattgtgagacacatttaggagcacatcggattttctctgttgttcttgttccctcttccgttgctccgttttcat

SEQ ID NO: 35537 - protein, 155 aa, Zea mays; identical to SEQ ID NO: 23834
  misc_feature: Ceres CLONE 1415017-F

SEQ ID NO: 35538 - DNA, 678 bp, Zea mays
  misc_feature: Ceres CLONE 1415025-F
  misc_feature (494)..(494): n is a, c, t, g, unknown, or other
aaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccgggaagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtagatagtagacttgttcgagnttagcttggctggaagaattagtctctggtccgtgtttatatctgctagcaataatggctgcgatgaacggagaggtattgggtgaatgtgaacgaacataaatagtctcaagagaaagcgggagagccccgctgcatatgctgctggcgtattctgcacctctgaattgcatcagcatactgg

SEQ ID NO: 35539 - DNA, 784 bp, Zea mays
  misc_feature: Ceres CLONE 1415029-F
  misc_feature: Encodes the peptide sequence at SEQ ID NO. 35540
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (50)..(50): n is a, c, t, g, unknown, or other
  misc_feature (51)..(51): n is a, c, t, g, unknown, or other
nnnccccccccccccccccnnnnnnntttnaggnnnggtggttctttttnnttcaaagctggagctccaccgcggtggcggccgctctatacactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatcgatatgccgttcggccacacgcggctcgatgtccggcgtccgccgcagtcgtcctacctctgctgctccacaaccaccgtcggcgtattcgtcgccgctctgcctggtggctgtgtggatggcgtcgtccatgctcgacacccctgccgagttccctccgtttcagtcccaagtgcgtccactgaggcctcatgactctcctcctgcccccggaagcttaaccagcgctgatcagggctgatggcatcaccacaccatggatggatccaccagcctggctaacaaaaaagtggacatccgggaaacagaacaaaacacggaatggtggaaaacccccgccaaaaaagaaccttttttctccgaacacgaagctgggggacaccattggtgatcaaaacacaagtgggtggagaagcaccgcctatacccaag

SEQ ID NO: 35540 - protein, 70 aa, Zea mays
  misc_feature: Ceres CLONE 1415029-F
MSGVRRSRPTSAAPQPPSAYSSPLCLVAVWMASSMLDTPAEFPPFQSQVRPLRPHDSPPAPGSLTSADQG

SEQ ID NO: 35541 - DNA, 656 bp, Zea mays
  misc_feature: Ceres CLONE 1415031-F
  misc_feature: Encodes the peptide sequence at SEQ ID NO. 35542
gctcttgaactagtggatcccccgggctgcaggaattcgcacgagaccattacctagaacatcctaatcgaaaaaggaagccaatcgccagccagccaggaagcgctcctgcacctgtcctgcatacgcccaacggcctaatatttgcgtagccgctacaacctacatgattctcgatccgtcacccatccgttccggatcttgattcttgccaaggcgtgcaagattcctgcttcgccgaggttaaattttagccgccggccgagcttctgcggagaaccggcaggtttgcttggtgccctcgatttgcctgctactcgtggcgcgccgctcctaggccgaagggaaggatccgactcaacatggccgccgccgcttctaccatgtccctgctcccgatctccccagcccaggaagcagcagcagcaaggcgcgggcgccgtggtcgtgttccagcggcggccctgggacgcgcgggggaggtgatacgtcgtcccgacggggaggctggtcgggccagcgatcttcgaggggccaagctgaaggtgctgttcctgggggtggacgaggggagcagcaagcatctgcatggcaccaccccggcgccgggggccggggctgcttgccgcggacgtacacgctgaacgcacaaggag

SEQ ID NO: 35542 - protein, 93 aa, Zea mays
  misc_feature: Ceres CLONE 1415031-F
MAAAASTMSLLPISPAQEAAAARRGRRGRVPAAALGRAGEVIRRPDGEAGRASDLRGAKLKVLFLGVDEGSSKHLHGTTPAPGAGAACRGRTR

SEQ ID NO: 35543 - DNA, 846 bp, Zea mays
  misc_feature: Ceres CLONE 1415038-F
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (846)..(846): n is a, c, t, g, unknown, or other
nttttcccccccttnntccnnntcccccctcggctcttgcaccctttttacaaagctggaactccccgcggtggcggccgctctagaactagtggatcccccgggctgcaggaattcgcacgagaccattacctagaacatcctaatcgaaaaaaaaaccaccgcgccgaatccgaatcgagtcgagcaagcagggagctagcgcacgcatctaggctaggcgagagcaccaaaggaggcgccgcgggtggcggcggaatgggaaggccccctccgcgcgatcatcggccgctaccccgtcgggggccggcggcaacaaacagcttgggaaggcgcgcccgcaggcgccattatacgccacgaccgcagggggcccggacatcgccgttcctcgtagctcttcgcccggccttctggggtggccatggattgtccaactcccgggttcggggttccaccagggggcaacccggctccgggttggaatttatgaaacctggactaccaaaaggggaaacgttcgggggggcgataagcgcttggcaaaccccaaattttgggagggaacctggggctggtaaagaaaacctggaatggaaatccccaaaccccaggctctccccaaaaggggggacttccaaagaacacagaaaggggtaacccccgtggcttaaggccccaagaccctttctggcgctggagtggaggcgcccccaaactccccggtcggaaaaatgggaatttgacacttattttggggtctcttccccgaaaagggcaaccaacacccccctcctccgggcggatagccctgggggccgccataagtggacctattggcttaan

SEQ ID NO: 35544 - DNA, 759 bp, Zea mays
  misc_feature: Ceres CLONE 1415045-F
  misc_feature: Encodes the peptide sequence at SEQ ID NO. 35545
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (52)..(52): n is a, c, t, g, unknown, or other
nnnggggcccccccccccccccccccnnnnggnnnanacaanngtcccgccnccccaacagctggactccaccgcggtggcggccgctctagaactagtggatcccccgggctgcaggaattcgcacgagaccattacctagaacatcctaatcgaaaaaccatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcgggggctctccgtacgaggacgcgcgcgtcctgaacatggcccacttctcggacgtgctggcggacacgtcggcgtcgtccccgtcgcagcggttcgtgtcggaggaccgggtgatcaactccccccccgcgcgtgctggggcgggggaagctgcaacaaacgccggctttcttcaacgcgcgcccggcggggagctaacgttcaggggccgcccggctgggtgacccccaggggaaggttgccgggccgggcgttaacccgtttgggatgggaaaggaaaccgtgggttccgggggtttcccggccccgggg

SEQ ID NO: 35545 - protein, 143 aa, Zea mays
  misc_feature: Ceres CLONE 1415045-F
  misc_feature: SWISSPROT Homolog: EC 4.1.2.10 Mandelonitrile lyase
MATILTVASFFALVCISQQARAANYTFMKDAVHAPRTGFYDYIIVGGGTAGCPLAATLSARARVLLLERGGSPYEDARVLNMAHFSDVLADTSASSPSQRFVSEDRVINSPPARAGAGEAATNAGFLQRAPGGELTFRGRPAG

SEQ ID NO: 35546 - DNA, 722 bp, Zea mays
  misc_feature: Ceres CLONE 1415051-F
aagctggagctcaccgcggtggcggccgctctagaactagtggatcccccgggctgcaggaattcgcacgagaccattacctagaacatcctaatcgaaaaaaacaaagctgccggactgatcgttgtttgctcgcagttgccagccctccgccgccagccacgtactccataggaagcgaatcaagtgcgactgccaccgacgtcgaataaagcatgcaatgccagtggcgcgatggaaacccaattctcgcctgccgctggcgagcgacccgggtcccccccgcgccgatagggatcccgcgcgggaaggctctccgcgcgccgctcgctgacggggtgaccagcacgggggcgcaagacgcctcgcactacgcgctcggcgatctggtggagggctccgtgctctaggacaacgcaaacatcgacgcctcactgcgaacgcacgctacccgaggaagtaggccaagctctcctccttcgaatgcgccaccgtatgtccccaaatcgcctaagaaaagacatcggcgggcttcggcctcggagaaataaattcgggggaagagagaaaggcggccggattggatgcatactctccgcatcaaggaatcggccaggaaggaaaaaaaagaggtacccgacggatcctaaaaggcttgggacccaaacgggttccgaaaaacctcccgttgaaaaagaaaccggcccacctaaactcgggag

SEQ ID NO: 35547 - DNA, 706 bp, Zea mays
  misc_feature: Ceres CLONE 1415052-F
  misc_feature: Encodes the peptide sequence at SEQ ID NO. 35548
aaagctggagctccccgcggtggcggccgctctagaactagtggatcccccgggctgcaggaattcgcacgagaccattacctagaacatcctaatcgaaaaagatcaaccctcccctccccggcccgacgcccctcgccccccctcctgaccggccatggcgaccgctgctgctgcgtcccgggtggctgtctcggcgccggtcttcggttcggacggcggcgccaggagctccgggatcaagggcaacaacaatgttagcttcggcagcaaatcatgggtcggcggcacattgggctgggagagcagctgctcggtgcggccccagcacgccagcaaggtgctctgcatgtcccgtcagcaggcgagcaggagtaaggtctccgtcgcgccgctccatctcgagagcgccagggagcacctcctcacacgtacaagcccaggagcccttcacggccacattggctcggtggaaagtttgctcgcccccaagcttccggggaagactgcccaattgttatccaccatgggggaaatgggccgtatgtggaaggccaaatttaacggttctttccctctgggaaaaatccctaaaaagccgggagcccccaaaaaggggcggtttttttccatggcctcccaagggggggggaaaaccttctggggggaccccaaaatttgtggcgcccccccgggatattttagt

SEQ ID NO: 35548 - protein, 183 aa, Zea mays
  misc_feature: Ceres CLONE 1415052-F
  misc_feature: SWISSPROT Homolog: EC 1.18.1.2 Ferredoxin--NADP(+) reductase
MATAAAASRVAVSAPVFGSDGGARSSGIKGNNNVSFGSKSWVGGTLGWESSCSVRPQHASKVLCMSRQQASRSKVSVAPLHLESAREHLLTRTSPGALHGHIGSVESLLAPKLPGKTAQLLSTMGEMGRMWKAKFNGSFPLGKIPKKPGAPKKGRFFSMASQGGGKTFWGDPKICGAPPGYFS

SEQ ID NO: 35549 - DNA, 654 bp, Zea mays
  misc_feature: Ceres CLONE 1415053-F
  misc_feature: Encodes the peptide sequence at SEQ ID NO. 35550
  misc_feature (427)..(427): n is a, c, t, g, unknown, or other
tggagctccccgcggtggcggccgctctagaactagtggatcccccgggctgcaggaattcgcacgagaccattacctagaacatcctaatcgaaaaactcgcaccacgccaccgctgctgcctgctcctcacagtcctccccgcgctcgcattgcgatttgcgacctagcgcgagggtaccgggggggtggtgcgcgcgcgtgctcggtgatccgggaacgcccgagatgccggggtggaggcggcgtgccgcgccgaagacgacacttcacgccgaccccgtcaagaccagctccctggggtctctactgcataccagccctccccgtggcctgaagcgttcttcttggggtccacattatctggtcatgcttggtaccactgtgatcataccaactgcacttgttccacaaatgggagggaacnattgaggacaaagcagtggttatccagacattgctggtcgttgcaggtatccacaccctcctgcagaggttctttggtaccatgttgcctgcagtgatcgccggtcaatacaccttggtctgcctacaattcgatcatccttgctggaggtatggtatggaccttacccccttataaatttctcccgatctgcggggaaccagggggggtgatgggggctccagcta

SEQ ID NO: 35550 - protein, 31 aa, Zea mays
  misc_feature: Ceres CLONE 1415053-F
MLPAVIAGQYTLVCLQFDHPCWRYGMDLTPL

SEQ ID NO: 35551 - DNA, 727 bp, Zea mays
  misc_feature: Ceres CLONE 1415057-F
  misc_feature: Translation starting site: 172
  misc_feature: SWISSPROT Homolog: EC 4.1.1.19 Arginine decarboxylase
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaatccccacagcattaaaatctgttcatctctggctccccaaattcggctggagaggactttttcccatcatggataagaactacggtgaactctacaacatcctcggatggggtgaggagtacttcgcggagaacacggaggggcacctcagcgtgaagcctttcggccgctgtacggagcccggtcaggagatcgacgtgcactcggtcatcgtggaagctctagcgacgcaacccgacgacagcaccagcaaatctcagttccccatgatccttcgcttccccgacgtgctcaagaaccgtatcgagacgctccataacgcattcaacagcagccgtggagtccaccgggtacacgtccagtgtaccaaggcgtgttcccgatcaaggtgaaccagaacaagcacgtcgtgcaggacaattgggtaggttcggccagaaatggaactatggggctcgagggtggctccaagccagaactgctcatcgacatgagctgcctcgccgtcaccgaaggcgagcccaagcacgtacttgatctgcaacgataaaaggacgcggactacatcgcgctcgcgtttctcggtggcggnccatgaaactgaaacccatcatcgtgttcgag

SEQ ID NO: 35552 - DNA, 756 bp, Zea mays
  misc_feature: Ceres CLONE 1415058-F
  misc_feature: Encodes the peptide sequence at SEQ ID NO. 35553
  misc_feature (434)..(434): n is a, c, t, g, unknown, or other
  misc_feature (455)..(455): n is a, c, t, g, unknown, or other
  misc_feature (459)..(459): n is a, c, t, g, unknown, or other
  misc_feature (484)..(484): n is a, c, t, g, unknown, or other
  misc_feature (492)..(492): n is a, c, t, g, unknown, or other
aaagctggagctccccgcggtggcggccgctctagaactagtggatcccccgggctgcaggaattcgcacgagaccattacctagaacatcctaatcgaaaatcttaaatcccacctctccccgtctacgcctcattcgctccagctcgcatcccacagccaagccagttagcccgggagatctccaagaaaccatcttggaatccgagaacgcccagcattcttggtcggccaaggattcgaattccgacgaacggcttctacggccgaaaaaagtccgataatttccgcggggagctcaggaggtgtctcggtctcgggaaccggaggaggaggccgtgggggattgacgagggggcaagatggtgagggctgcgtacacaacggcgctgaccacgctgttcagctacggcctgctctttcgcttcggcagntcaagggattcttccgcaagntcgncgactggggtcaggggcaagaacgncagggggnacgcgccgatctgcctgggccctgaaggatttcaatgggggacgcctggaattgcggatccaggattgcttgggaaggccgaatcgaaggggccaaaatcaggggtttggagggtgtggagggcccctccaggggcaaaacagagacctacgggggaacccgaaaacccccaagaggcccaaccggggcccaaaaataaccttggtttttgtggacaaaaagggacctggcacccctgggttttggggtcccaaaaaaaaccca

SEQ ID NO: 35553 - protein, 131 aa, Zea mays
  misc_feature: Ceres CLONE 1415058-F
  misc_feature (24)..(24): Xaa is any aa, unknown, or other
  misc_feature (31)..(31): Xaa is any aa, unknown, or other
  misc_feature (33)..(33): Xaa is any aa, unknown, or other
  misc_feature (41)..(41): Xaa is any aa, unknown, or other
  misc_feature (44)..(44): Xaa is any aa, unknown, or other
MVRAAYTTALTTLFSYGLLFRFGXSRDSSAXSXTGVRGKNXRGXAPICLGPEGFQWGTPGIADPGLLGKAESKGPKSGVWRVWRAPPGAKQRPTGEPENPQEAQPGPKNNLGFCGQKGTWHPWVLGSQKKP

SEQ ID NO: 35554 - DNA, 724 bp, Zea mays
  misc_feature: Ceres CLONE 1415061-F
  misc_feature (324)..(324): n is a, c, t, g, unknown, or other
  misc_feature (325)..(325): n is a, c, t, g, unknown, or other
  misc_feature (476)..(476): n is a, c, t, g, unknown, or other
  misc_feature (490)..(490): n is a, c, t, g, unknown, or other
  misc_feature (545)..(545): n is a, c, t, g, unknown, or other
  misc_feature (616)..(616): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
aagctggagctccccgcggtggcggccgctctatcctagtggatcccccgggctgcaggaattcgcacgagaccattacctgaacatcctaatcgaaaaacactacatcccacctacctcctcgcatcaggcaggcgggcctcgcgtttataagccacccttcctctcctccacggccctcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgccgggccgcggnncgtgccgtcgtcgctcacgctcgcggcgcgcggcggggccggggccggcgcgcgtctccgcgtgcggtgcgcgatcttgtcgtcgcccgcgcccgtggcgcccaccgagtcgaggccggcgcgccggatctcgccgtccgcgccggacggngcgctgcggcccangccggcggtgctggtcgccgagaagctgaccgaggccgggctgcccgtgctgcgncagttcgcggacgtggagggcgcctaggtttgtcccccggggagctctccccaaggcggggcaattcaacncgctcatcgggggactcggcacccaggtgaacccggaagttgatgcgagnnnngaaagaccccccctccgactgtctaccccttttttttctagtgcgtccgtctcgt

SEQ ID NO: 35555 - DNA, 721 bp, Zea mays
  misc_feature: Ceres CLONE 1415065-F
  misc_feature: Translation starting site: 175
  misc_feature: SWISSPROT Homolog: EC 1.13.11.51 9-cis-epoxycarotenoid dioxygenase
  misc_feature (442)..(442): n is a, c, t, g, unknown, or other
  misc_feature (443)..(443): n is a, c, t, g, unknown, or other
  misc_feature (609)..(609): n is a, c, t, g, unknown, or other
aagctggagctccccgcggtggcggccgctctataatagtggatcccccgggctgcaggaattcgcacgagaccattacctagaacatcctaatcgaaaaagaatcttctgccactgcccttccatctcgtcccttagctacaagtcatctcgccgcaaccggaacccgcagccatggggacggaggcggagcagccggacatggacagccaccgaaacgacggcgtcgtggtggtgccagcgccgcgcccgcgtaaggtgctcgcctcctgggcgcttgacctgatcgagtccctcgccgtgcgcctcggccacgacaagaccaagccgctccactggctctccggcaacttcgcccccgtcgtcgaggagaccccgccgggcccaaacgttagcgtccgcggacacctcccggagtgcttgaatggagagtatgtcaggnntgcgcctaatccgaagtctgctcctagtgcgcgtatcactggtttgatggagacgggatgattcatgccatgcgtattaaggatggaaaagctacctatgtatcaagatatgtgaagactgcccgcctccaacaagaggagtattttggtggagcaaggttatgangatcgcagaccttagggattttttggattgtttatgggcccaatgccaccactcggaaaaaattcaaagtctgggattttacctaaggattggggacggtaatactgcactt

SEQ ID NO: 35556 - DNA, 721 bp, Zea mays
  misc_feature: Ceres CLONE 1415066-F
  misc_feature: Translation starting site: 217
  misc_feature: SWISSPROT Homolog: EC 2.3.1.61 Dihydrolipoyllysine-residue succinyltransferase
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaaaagtcatagggacattgcattggggaactacagaaaagggtccgaatcgaatccgtggtgcactgccccttcctcccccacaagccgccgccgccgccgtgaggactccggcgaatggcgtcccgcgtcgcctcgggcctcctccgccgccgcgccggcgccacactaggcctcctaaggagttatgcacatgtcagaagctacaacagtcaactttcagctttggtttctgctacatctgaatgctcaaatctgccgagaagatgctattacttacctaatccctctccataccaagntttggagtaggtcatttgcttcagacaacggagaacagtttggaggctgttgtgcccttcatgggtgaatctgtaactgatggaactcttgctaacttcttaaagaaacctggagacagagtcgaggctgatgaacctatagcgcagattgaaactgataggtcactatagatgtcgcagtccttgaggcttgtggttattgaaaagctcattgctagggaaggcgacacagttactccaggcactaaagtgcattcatatcccagtctgctcaactgctgaaacaatgttgctccctcagaggaagcaacttccaaaga

SEQ ID NO: 35557 - DNA, 751 bp, Zea mays
  misc_feature: Ceres CLONE 1415069-F
  misc_feature: Translation starting site: 182
  misc_feature: Pfam Name: HMGL-like Pfam Description: HMGL-like
  misc_feature: SWISSPROT Homolog: EC 4.1.3.4 Hydroxymethylglutaryl-CoA lyase
caaagctggagctccccgcggtggcggccgctctagaactagtggatcccccgggctgcaggaattcgcacgagaccattacctagaacatcctaatcgaaaagtttcctctctccaattcccacccgcgtcaaggagcttctcgtctgagcccgagctaacaagctcaccggcgggcaggatgctggcggcgtccaccaaggtcggctctaggctggcctctccgcacgcctccttgtccgccggtgctgcagcggcggcgctggcgagctcccccgtgctgggctctgggatgctcccaggcgccgggttcggcgagacggggagtcaccacgcggcggacgcgccgccgccgctgccttgcagttcctcgggcgattcaagggaatattatcagtggaagagactggtgaatcaaaggcagtcaacgctagatggaggcaaagtgcctgctgcattgggccaccatgttttttggtggcggcttttcctcacggaaacaacatatctacagatatttttcatcttctcatcaagggagtatatggggccgggagcaaggttctacatgacctgccagggtatgtaaaaattgtggaactagggccacgagatggtctacagaatgagaaggacatcgtgccaacacctggaaaaggtgagcttatacgaagattgccacatccggattacctggtggggaaggcaacgagttttgtatcttcaaaagggggacctcagttagttgatg

SEQ ID NO: 35558 - DNA, 738 bp, Zea mays
  misc_feature: Ceres CLONE 1415075-F
  misc_feature (371)..(371): n is a, c, t, g, unknown, or other
  misc_feature (425)..(425): n is a, c, t, g, unknown, or other
  misc_feature (472)..(472): n is a, c, t, g, unknown, or other
aagctggagctccccgcggtggcggccgctctagaactagtggatcccccgggctgcaggaattcgcacgagaccattacctagaacatcctaatcaaaagatcttatgcttccatctctgaggctgccgccagccaccggccagcgtcgttcgctttgtagcagtccagctctgcgcccggcgccgcagccccgcatcgcgcacaggcacaacttctacggttctgccgctgatcgccgcacgtggccgcgccgccgcctccctcacccgagctcgaccgcgcttctccagctcgccgcctcgacggtcgctgcctcgacacctcccccgcgtgggcatcagccgggagcagagagccctgttccctggnagcgcgtcgcgtttacggcggagcagcgccctcccagccccctttggtgatcgntcctcccccggcagactcgcctcctcgggtttgggcttcctgccggnttggccgccaaacgccgtgccccgtgggcggatgtaaacagacaacggcccccccccgaaaggaaggaatttccgattcgggaaccccccctcaggcccctttgtcgggttccagccccagtttggctttgaaggctcaaacccccgccaaagatttttaaaacccccccccccttaaatttccccccccgggggggggggtccccctggggggggggtccccccccttaaaaagggccccccgggggggaaaaagtttttttggg

SEQ ID NO: 35559 - DNA, 726 bp, Zea mays
  misc_feature: Ceres CLONE 1415081-F
  misc_feature: Encodes the peptide sequence at SEQ ID NO. 35560
  misc_feature (393)..(393): n is a, c, t, g, unknown, or other
caaagctggagctccccgcggtggcggccgctctagaactagtggatcccccgggctgcaggaattcgcacgagaccattacctagaacatcctaaaaaaaaaaacctagctagatttagaggaaaaaaaaaactgtccccaaccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgctgacggtcgctcctcccagccccagcatgagactcaatcacatggggcagtggttcctccaaatctcgagaaagggaccgagaacgtgataagggaaaggacaggnagcgaggcagagaccgtgtccgcgaaaaggagagggaccgagacagggacaaggatcgtgaaagagtgacagagacagggatcgtgatcgccaccacatggatcgtcgcgagcgcagcgagatagggaacaccgtgatcgttctgatgatcgtgacgtcaccgcgatgatcgtgaccgtcgcaggagtcatgatctgagaggagagagatcgtgacagagatggccatcggaggattcgctcccgttcccttcttagagtcgtgaccgtgacggaaatctagatctcgtcacgctctagacgagaagaagcggggtggatggttttgaccaac

SEQ ID NO: 35560 - protein, 103 aa, Zea mays
  misc_feature: Ceres CLONE 1415081-F
MAEYGERYQGNGDPATPEGGYAQTEYAAAGGSPPADRKPSVFSDHADGRSSQPQHETQSHGAVVPPNLEKGTENVIRERTGSEAETVSAKRRGTETGTRIVKE

SEQ ID NO: 35561 - DNA, 732 bp, Zea mays
  misc_feature: Ceres CLONE 1415082-F
aaagctggagctccccgcggtggcggccgctctagaactagtggatcccccgggctgcaggaattcgcacgagaccattacctagaacatcctaatcgaaaaaccacactcactctctcgcttgacctacccccctccgccccccgccgggcctgcggggtgttcgacgcttcgcccgcccgcccgagcgccgccacggcatggcttcctccatctccgccgccgctaaggcctccgcggcctttgcccaatagaaggagctggccgcgccggcggcgcaccgcgcgggctcgagccgtctgatcagcccgtgccgcgtgcgcgccatagcgtagcccgcgcgatgcccgcgtgccgcgtcgtgcaccggctcggggaagaccgcgatgactataacggagtactttccggaggagggccgaaatagcgctcggccctggtatcccgcatacacgggttgaacgatttgccgccaattacatgtagactggaagaatgcggacaacgttaggggggtaattttcaagaaccaatccccgggcacctggcgtattctagaccctcggaagtaatcttgcccccggcatggaaaccgggcgtctcttcggggcactgccgggtggccccttcaaatacgcctttcttcctatattccttgctggcgtcagacccacggccctgtggtttttcttggttccccgtgcctaacgcgcgcgtatctctgattcctgg

SEQ ID NO: 35562 - DNA, 760 bp, Zea mays
  misc_feature: Ceres CLONE 1415084-F
  misc_feature: Translation starting site: 227
  misc_feature (547)..(547): n is a, c, t, g, unknown, or other
  misc_feature (548)..(548): n is a, c, t, g, unknown, or other
  misc_feature (563)..(563): n is a, c, t, g, unknown, or other
  misc_feature (613)..(613): n is a, c, t, g, unknown, or other
  misc_feature (614)..(614): n is a, c, t, g, unknown, or other
  misc_feature (630)..(630): n is a, c, t, g, unknown, or other
  misc_feature (631)..(631): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (655)..(655): n is a, c, t, g, unknown, or other
  misc_feature (657)..(657): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (671)..(671): n is a, c, t, g, unknown, or other
  misc_feature (692)..(692): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (705)..(705): n is a, c, t, g, unknown, or other
  misc_feature (735)..(735): n is a, c, t, g, unknown, or other
  misc_feature (736)..(736): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
aaagctggagctccccgcggtggcggccgctctagaactagtggatcccccgggctgcaggaattcgcacgagaccattacctagaacatcctaatcgaaaaatgtgatgtgagcctggcagcctgctgcctgcccgcgtccccgggactagttcagttgcttcactgtggcggtggcctggccctgcgtgccgcgtgcgcgctgcagcagtgcggtagcgggcagatggccgactccacggccatgaccgtcgacttcctccgtgcgcggctgctctccgagcggtccgtctcccgcgccgccaaggagcgtgcggacgagctcgccaagagggtcgcggagctggaggagcaggtccgggcggtgacggcgcaaaggcggaaggcggagtgggcgaccgcccaggtgctcgcagttctggagtcccagggctttggcgaccatctctcggatggggccgacgactccgacggctctgaagtccaggacggcgagggagaagaacgcaagaatcggcgggacacggccggggccgccggagacganngcaaaaaaagaaccncgagcaaccaaggcaaggcgaaaggaccagcggcccgaaaccacagcccnnccccggggggtattcnnaaaaagnnnaaggcgagcgccccngnaggggnnnnnnncncccccgaaccgaacccggggngnnnnnnaggacnggacgcccacggggaagcccggagagaagnnactgnnngtgcacccctcataaat

SEQ ID NO: 35563 - DNA, 765 bp, Zea mays
  misc_feature: Ceres CLONE 1415085-F
  misc_feature: Encodes the peptide sequence at SEQ ID NO. 35564
  misc_feature (480)..(480): n is a, c, t, g, unknown, or other
  misc_feature (574)..(574): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaactagcttcccactccgctcggccaccagctttgaccgcctcccctcccctccgctcctgttcttccataccccactcccccgcaggagcggcgcggcggcggcaaaggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcaaagcctatgagggttttgagtgatccagagaaacgtgagatttatgatcagtatgggtgaagatgcccttaagaaggaatgggggtggttggtgnatcccatgctgatccatttgacattttctcatcattctttggaccctctttttggagggaggggtggaagcagcagggggaagaaggcaaaggnaggggagaagatgaagnccactcactttaagtttctctgggagatctttacaatgaaatctccaagaagctctctcttttcccgaatgcatctgctccaagtgcagggcaagggctccgaatctgtggcttccatgaagggccctgggggccaggctcaaggaatgaagcaccatcggcaggtgggcccct

SEQ ID NO: 35564 - protein, 74 aa, Zea mays
  misc_feature: Ceres CLONE 1415085-F
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAKPMRVLSDPEKREIYDQYG

SEQ ID NO: 35565 - DNA, 768 bp, Zea mays
  misc_feature: Ceres CLONE 1415089-F
  misc_feature: Encodes the peptide sequence at SEQ ID NO. 35566
  misc_feature (596)..(596): n is a, c, t, g, unknown, or other
aaagctggagctccccgcggtggcggccgctctagaactagtggatcccccgggctgcaggaattcgcacgagaccattacctagaacatcctaatcgaaaaacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctgggcgggaacgcggcgaaggacaacaagaagacgcgcatcgtcccgcgacacttgctcctggcgatttcgtaacgacgttgagctcggcaagctgctgtctggcgtcacatcgcgccaacggcggtgtcctcccaaacatcaccccgggtctcttgccccagaaagtgggcggaaaaggcgtccagcggcgncagcaaggagagcaagtcccctaagaaggccgccaagtcccccaagaaagcagccaaagcccccgaagaaggcttagaaaataggcacttcactagcgctctgctgaaccatgttccgggttagatctggggaaacttatgggttccgcccaattccctctttgcttggggt

SEQ ID NO: 35566 - protein, 100 aa, Zea mays
  misc_feature: Ceres CLONE 1415089-F
  misc_feature (29)..(101): Pfam Name: Histone Pfam Description: Core histone H2A/H2B/H3/H4
MDASGAGSKAKKGAAGRKAGGPRKKSVSRSVKAGLQFPVGRIGRYLKKGRYAQRVGTGAPVYLAAVLEYLAAEVLELGGNAAKDNKKTRIVPRHLLLAIS

SEQ ID NO: 35567 - DNA, 670 bp, Zea mays
  misc_feature: Ceres CLONE 1415095-F
  misc_feature (52)..(52): n is a, c, t, g, unknown, or other
  misc_feature (275)..(275): n is a, c, t, g, unknown, or other
  misc_feature (304)..(304): n is a, c, t, g, unknown, or other
  misc_feature (305)..(305): n is a, c, t, g, unknown, or other
aaagctggagctccccgcggtggcggccgctctagaactagtggatcccccngggctgcaggaattcgcacgagaccattacctagaacatcctaatcgaaaaaaaaagaaaccgagagctagtgcttgattcggtcgtttttgggcaccgaacacgttcttgggaccgccgccgccgccctacttccagtcccagctgctcaggtctccatcggcctcgagccctttgccggcgacgagcactcacaacaccagggtgtaacaatgtcttcttncatggaatcgtcatacctttcctgctacnnactgagtcatttagcccaggcctcaaggagggctaaagggatgggtttcaaaagggccattttttcaaaacccttttaaccgggggggattttttggagagaccccccactctcttttttggggggggggggccccccccaaaaaaaaaaaaaaaaaaaaaaaaggggggggggggaaatttaaaaaaaaaaatttttttttttaaaaaaacaccccccaccaaaaaccctcctcccacaaaaaaaaaaaagggggggggggggggggttttttttttcccccaccccaccccaattttttttttttttttttttaatcttaaaaaaaaaaaaaaaaaaaaaaaaaggggggggcggaggaagtt

SEQ ID NO: 35568 - DNA, 682 bp, Zea mays
  misc_feature: Ceres CLONE 1415112-F
ggagctccccgcggtggcggccgctctagaactagtggatcccccgggctgcaggaattcgcacgagaccattacctagaacatcctaatcgaaaaattccttccctctttcccgatctcactggtaggtactgcctccatcatcctcccagagagagactgagagagagagagcgcagccgaggcagttcgcccgcatgtatcccgctgctgcagagatcacgcccagcttctgcgcctgcagctccagcagtagcagcaccaggggctgcagtgcaaacgcgcgctgctagttcccgttctccccatgatctctgccctttcccctactttttcttgttcttgcttgccccttttccttctgcgctagctgccgcttcttcgccttcctggagctccccgcatccacacatacctctaaagaaccagacatatagacgacacagaaccgtcggagtcctcttctactactgtctccagtatatggggtttgtggtgcacaggtgcgcggacataggtagaaccgtaaaaggaagattattcgctcgagggcacagctttggttgctggggcaccgcgatcgacctccagggaaaaaaattattgggggaaggggcggaaggcatggaggaactgtacagcatccacccggggatctcacgccgccgggggccccccacgg

SEQ ID NO: 35569 - DNA, 618 bp, Zea mays
  misc_feature: Ceres CLONE 1415117-F
  misc_feature (227)..(227): n is a, c, t, g, unknown, or other
aagctggagctccccgcggtggcggccgctctagaactagtggatcccccgggctgcaggaattcgcacgagaccattacctagaacatcctaatcgaaataccctctggcattggttgtcgatttcttcgttcgtgcttgcttgcgtaaatatttaaataaaatgaagcaaatatgggcacaaaagctcgtccaccatctgctgatgcagaaaaaggggaaatggncgaataaaaacaagggcttccaattcaacttgttaaagttgcagggagttaattgggggaggcccgttttcttttgaaaaacccgttgaaaaaaaacccaggggccccaaaaaaaaaagggttttaaccaaggaaaaaaaattgcacatgggcccaaaaaaatttgaaaaaaaaaaagggaaaccctcctaatggggggaaaaaaaaaaagaaaggggtttcttcttgggttgagaaaggtgtaaaaaatggtggggggggaaaaaaacccccggtggtgttttttttaaaaaaccccaaaaggggtggcccccccccgcggagggaggggggaaaaccctttcctcccccctttttttggggggggccaccaagaggattggttaaaaaa

SEQ ID NO: 35570 - DNA, 753 bp, Zea mays
  misc_feature: Ceres CLONE 1415121-F
  misc_feature: Encodes the peptide sequence at SEQ ID NO. 35571
  misc_feature (342)..(342): n is a, c, t, g, unknown, or other
  misc_feature (343)..(343): n is a, c, t, g, unknown, or other
  misc_feature (354)..(354): n is a, c, t, g, unknown, or other
  misc_feature (355)..(355): n is a, c, t, g, unknown, or other
  misc_feature (361)..(361): n is a, c, t, g, unknown, or other
  misc_feature (392)..(392): n is a, c, t, g, unknown, or other
  misc_feature (405)..(405): n is a, c, t, g, unknown, or other
  misc_feature (475)..(475): n is a, c, t, g, unknown, or other
  misc_feature (478)..(478): n is a, c, t, g, unknown, or other
aagctggagctcaccgcggtggcggccgctctagaatagtggatcccccgggctgcaggaattcgcacgagaccattacctagaacatcctaatcgaaaaaatagcctctcctcgcaccccctcaagaactgtacccatcacgcgccgccatcgattgaccttgaccgacccgacccaccatcacgcttcttgttgcccgccgctgtgcttgccatacgcggtggctgcgctccgcggcggggaagaagggtcgcgggctgcgccctccagtctttcttcgcctcgtgctctcgggcctcttcggcaggccgaccaggacgaggaccaagagatgggctcgnngaaacacaaanngcgcgntccgcagcttcaccatcagaagcgagccggntgttccgctcttngaaaagacaaaggccgtgcccgcccggaactgacgcttctgaaccggggaccccccttctcggggatatncgnaaaccttcgtcagcggtccgcccaggcacaggggaacccgcagggagcagggtcaacccgccccaatcactaagaggccttcggcggctcaacttcttcaggaaaggcgcaggccgaaggcccgaaatcaaggattgccgccaatcctggcttggcgaggcaatgcccccgaagaaaagaaaagggagtgttcccttgttcaagaacccaccccgccggccgaaggaaaatcaaaaaacctcacctcccaaatctgaaaaggagaggggggggaa

SEQ ID NO: 35571 - protein, 37 aa, Zea mays
  misc_feature: Ceres CLONE 1415121-F
MPPKKRKGSVPLFKNPPRRPKENQKTSPPKSEKERGG

SEQ ID NO: 35572 - DNA, 704 bp, Zea mays
  misc_feature: Ceres CLONE 1415127-F
  misc_feature: Encodes the peptide sequence at SEQ ID NO. 35573
  misc_feature (289)..(289): n is a, c, t, g, unknown, or other
  misc_feature (337)..(337): n is a, c, t, g, unknown, or other
  misc_feature (421)..(421): n is a, c, t, g, unknown, or other
  misc_feature (443)..(443): n is a, c, t, g, unknown, or other
  misc_feature (468)..(468): n is a, c, t, g, unknown, or other
  misc_feature (513)..(513): n is a, c, t, g, unknown, or other
  misc_feature (537)..(537): n is a, c, t, g, unknown, or other
  misc_feature (597)..(597): n is a, c, t, g, unknown, or other
  misc_feature (634)..(634): n is a, c, t, g, unknown, or other
tggagctccccgcggtggcggccgctctagaactagtggatcccccgggctgcaggaattcgcacgagaccattacctagaacatcctaatcgaaaaacaagacgagatctacccgctgccccctcgcattcccctcccccgcgtcgtcatctccccaaatccccccaaaccctaccgccgatccggccccagatcgccatggccgcgcccaacagcaatgacgccgccagcgccagcggcaccggcccggctggcgaggaggacatctccatcgaggcgttggcgcgncgcgtgcaagagcacatgaccctcaactcgaaccccgccgctcgccgncacaagttctgggagacacagcccgtcggccagttccgcgacgccgccgacgcatcgctaccgaacggccccatcgagccgccnacgccactctccgaggtgcgcngcgacccctaaccactgccccgcgncttcgagtggctcacctgcgacctcgatgacgacgcgctcctcgnccgactctactcgttgctcgcccnacactacgtcgaggatgacgagaacatggtccgctttcactactccccggctttcctcgntggggcgctcaggcgccgttctttctttcgggctggnacattcgcgttcgcgcaagggagtcaagaagctcgtcgcctacatctcgggcgtccccgcccgcatccgc

SEQ ID NO: 35573 - protein, 84 aa, Zea mays
  misc_feature: Ceres CLONE 1415127-F
  misc_feature: SWISSPROT Homolog: EC 2.3.1.97 Glycylpeptide N-tetradecanoyltransferase
  misc_feature (82)..(82): Xaa is any aa, unknown, or other
MAAPNSNDAASASGTGPAGEEDISIEALARRVQEHMTLNSNPAARRHKFWETQPVGQFRDAADASLPNGPIEPPTPLSEVRXDP

SEQ ID NO: 35574 - DNA, 682 bp, Zea mays
  misc_feature: Ceres CLONE 1415128-R
ccaattgggtaccgggccccccctcgaggtcgacggtatcgataagcttttttttttttttttttaaattttctttttttttttttttttttttaaagcaaacataacaggggtcaaaatacctatagcatgggcaattatctgtcccgaccattacggtccaacaagggtaaccacacaaacacatatatcactagtccagagatatctgccagcaataaaataactgcaaggtactactcaaaatatcaaggaaacagcaagtcatggtgtcaaaaaccacacgcagaaaaaaaaataacttgaagttgtaaaccctaaattagatgcggaattatattaagcaacagcgcggaggaaaccgcccggcacggtcttggaaaatgtttgttccccattagctgctgaacctcaagtttcagccgaagattgggcccccccactgttttcaggagctgtcaaacctgttgttccaagggcacgcagcacgggcaccagagtgatcctgggatgcaccacgacgtgttgcttcactaaagaaagctggaggctgcccataacttgcactaccataagcatcgccataagactgctgctggccatagccctggcttgcaatgggtgcaccagggtaagctggaggtgcaccgtaaacaggatggctgtaagcatactgcccgca

SEQ ID NO: 35575 - DNA, 666 bp, Zea mays
  misc_feature: Ceres CLONE 1415128-F
  misc_feature: Encodes the peptide sequence at SEQ ID NO. 35576
aaagctggagctcaccgcggtggcggccgctctagaactagtggatcccccgggctgcaggaattcgcacagaacattaactaaaacattctaattgaaaagctgtcttatcctttcggccacgctttgtgcagccggcgcccaaaacctagcaatgcgtcctccgacatgtccgatgaccactactcctcttacaggaagtactaccatcccttcgccgccgtcgcgatgtactgggggtctcttcggtgccgtcgactgcctcggcgctcgcgtgtggggtctcgttgtacaacagcgtgccaccgtcgcccgatgagatccagctcgtcgaagcagctcgcgcaggatatcgcgtggcggatctttaacgccgcagagggcagcgtgactcgcgtggaccacggtgacgatgacagcggcggcttccgtgtacgcctgggcagcactggtggcggtgcccgcatcggaggaggaggactcggattctcgtcatctgacggtgctgggcatggcgcttctatccgacatttatcttgtcagagctgagcacatcagtactcctcttatggagggtatcagtgaactagcacatagatagaaatccgaatgggaggggttgctgttatcattggaaaaagcgggggaactattaggaatttcctg

SEQ ID NO: 35576 - protein, 62 aa, Zea mays
  misc_feature: Ceres CLONE 1415128-F
MTAAASVYAWAALVAVPASEEEDSDSRHLTVLGMALLSDIYLVRAEHISTPLMEGISELAHR

SEQ ID NO: 35577 - DNA, 695 bp, Zea mays
  misc_feature: Ceres CLONE 1415133-F
  misc_feature: Encodes the peptide sequence at SEQ ID NO. 35578
aagctggagctccccgcggtggcggccgctctagaactagtggatcccccgggctgcaggaattcgcacgagaccattacctagaacatcctaatcgaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgttcttcaaggtctttggcctccgccgttcttggacaggggcacaccactgtccaccggtgcccactacgcgaaatacgagtccctcgtgcggctccgtagggtggaagagatccatcaggcggtgagtgggaggggcggcgtccacacaaccggaggggaggggggcaatggcggccgtggcaggcccactctgcacgtggctcgtcgccgcgtgcttatctgcggcatgcgacgctgaagagcacaagcagaagcatttctgcgcaggcggaagccgcgctgggggcggtgtcatgctcggccagcgccgccgcctcggcgcgcggcgtcgcggcttggcgcgctctggaatgactatggctgttgccttacaagctgaaagaagtgtcattgaaaaga

SEQ ID NO: 35578 - protein, 77 aa, Zea mays
  misc_feature: Ceres CLONE 1415133-F
MAAVAGPLCTWLVAACLSAACDAEEHKQKHFCAGGSRAGGGVMLGQRRRLGARRRGLARSGMTMAVALQAERSVIEK

SEQ ID NO: 35579 - DNA, 689 bp, Zea mays
  misc_feature: Ceres CLONE 1415136-F
  misc_feature: Encodes the peptide sequence at SEQ ID NO. 35580
  misc_feature (474)..(474): n is a, c, t, g, unknown, or other
  misc_feature (562)..(562): n is a, c, t, g, unknown, or other
  misc_feature (638)..(638): n is a, c, t, g, unknown, or other
  misc_feature (658)..(658): n is a, c, t, g, unknown, or other
tggagctccccgcggtggcggccgctctagaactagtggatcccccgggctgcaggaattcgcacgagaccattacctagaacatcctaatcaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcgggaggccgtcgaccgtttcggtggcagcgccgcctggagctccgacctcgtcaggcgcatgttcgcgccctccaagaaacatgaacactctgaccaagctgcagaggccatcaacgccgaggagcaagctgcacagctagagaacgagctggcagttaaagaaagggagactcttgatgtgctcanggagctggaggcaccaagaagatcatagcagacctgaaactgaagaacggaagggaagcactgaaacatcccctgaaagagctgctgnacaggtttctgaggcgggagctcaacagcagaaactgaaaacacaacatggatgtggtgtggacatggaagggtanaggagaacattcaggtcggntccggtgatctcgagcagcgaagcaaactgg

SEQ ID NO: 35580 - protein, 105 aa, Zea mays
  misc_feature: Ceres CLONE 1415136-F
  misc_feature (97)..(97): Xaa is any aa, unknown, or other
MSSEAGCSAPAAAAPDGAGGGRVEIDTSAPFESVREAVDRFGGSAAWSSDLVRRMFAPSKKHEHSDQAAEAINAEEQAAQLENELAVKERETLDVLXELEAPRRS

SEQ ID NO: 35581 - DNA, 638 bp, Zea mays
  misc_feature: Ceres CLONE 1415140-F
  misc_feature (138)..(138): n is a, c, t, g, unknown, or other
  misc_feature (207)..(207): n is a, c, t, g, unknown, or other
  misc_feature (293)..(293): n is a, c, t, g, unknown, or other
  misc_feature (326)..(326): n is a, c, t, g, unknown, or other
  misc_feature (334)..(334): n is a, c, t, g, unknown, or other
  misc_feature (358)..(358): n is a, c, t, g, unknown, or other
  misc_feature (372)..(372): n is a, c, t, g, unknown, or other
  misc_feature (413)..(413): n is a, c, t, g, unknown, or other
aaagctggagctccccgcggtggcggccgctctagaactagtggatcccccgggctgcaggaattcgcacgagaccattacctagaacatcctaatcgaaaaaaggaaaaaaaaggatggctctccggcgcaacgccnggatccctccgcgctccgcgccgccgcctacctccgccgccaccgtccccatcctcctcccccactggncctcgccgcccccgctcccactcccatacgctccccgctggccccgcctttccggcacttcgctgctccgcctggtactcagaccnaatagaaaagcgagcagggagaggacgatgccngcgccggncccgcgcatgaaacaccgccatcnccgctccctttcgntaaggctcggcatggatgaaggcaccacattctcccccggnatgaaccttgcagttgggatcaggatggacatggacttgggttgaggcccaaaggaaatccaaccccccctgttgggaaaatccttggtttttccccggaggaatttttaaaaaaaaaccccgggggaaaaaaccgtttgaaaaaccaagtttgggatttggctttaaagggggggggggaaaaaaaaaaaaggggcttttttaggggaaaaatagaacaaaaaa

SEQ ID NO: 35582 - DNA, 669 bp, Zea mays
  misc_feature: Ceres CLONE 1415142-F
  misc_feature: Encodes the peptide sequence at SEQ ID NO. 35583
  misc_feature (227)..(227): n is a, c, t, g, unknown, or other
  misc_feature (412)..(412): n is a, c, t, g, unknown, or other
  misc_feature (499)..(499): n is a, c, t, g, unknown, or other
tcagaactggtggatcccccgggctgcaggaattcgcacgagaccattacctagaacatcctaatcgaaaactcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtgtagcgncgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcgncagttgaccctgaagatattccattggagaagttcaagttaaatcctcaagacatgttctgccatatgttggccgttgcttgtttgncggctattctggttggttaccattcttggtgtgtacaatggcgcacttgaatatctcgccaagggatcttgggattgctgaaaatgttgtcttggagggggggggtgataacccaatccttggtgggggggacatatagttcttttactgggggctccttggcaaaaaaa

SEQ ID NO: 35583 - protein, 123 aa, Zea mays
  misc_feature: Ceres CLONE 1415142-F
  misc_feature (17)..(17): Xaa is any aa, unknown, or other
  misc_feature (79)..(79): Xaa is any aa, unknown, or other
  misc_feature (108)..(108): Xaa is any aa, unknown, or other
MMRCAATGGGCVASCSXDRRLPAVNPCSVRMPTGNDGWCAGLRSRAADLAGLEMANLRGGVGGLFRASPRYGRLQATAXVDPEDIPLEKFKLNPQDMFCHMLAVACLXAILVGYHSWCVQWRT

SEQ ID NO: 35584 - DNA, 681 bp, Zea mays
  misc_feature: Ceres CLONE 1415148-F
  misc_feature: Encodes the peptide sequence at SEQ ID NO. 35585
  misc_feature (304)..(304): n is a, c, t, g, unknown, or other
  misc_feature (358)..(358): n is a, c, t, g, unknown, or other
  misc_feature (385)..(385): n is a, c, t, g, unknown, or other
  misc_feature (398)..(398): n is a, c, t, g, unknown, or other
  misc_feature (460)..(460): n is a, c, t, g, unknown, or other
  misc_feature (461)..(461): n is a, c, t, g, unknown, or other
  misc_feature (478)..(478): n is a, c, t, g, unknown, or other
  misc_feature (528)..(528): n is a, c, t, g, unknown, or other
  misc_feature (547)..(547): n is a, c, t, g, unknown, or other
aaagctggagctccccgcggtggcggccgctctagaactagtggatcccccgggctgcaggaattcgcacgagaccattacctagaacatcctaatcgaaaactgttttgttctccttctcattcgactctgatgatgacgagacggttatcgttccccttctggttcggtggagatcgccgccgttggcgtttcgatcgccatatttaaccaagtctccaaggtctgcatctaccctctcgttagcgtcacaacgtcgttcgtcgcggaggaagacgcgatcatcagtaagggcgtccgaggnaacagcagccaggaggaggacgtggagaaagcctcccacgtgggctttgatccngagacccagcatctgcatgcatctggnccctgcagtatgncagaatgcgtgaactcgtgtatcccctacgagtgcgcagcagatccctctgacaggcagggnncgtgcgagaagagtacnggtgcgtcgtacgtcggcgttatagtcggttcattctcgcctggttaggncgtcttcctggtctttcgncagatcgtgtcacatcagggggtaaagccggatccggatgcagggctggggggcgtactaacgaagggccttgggccccggttggtgctgctttgcatgaaggggtttcggggttcagggaccaaaaccgttat

SEQ ID NO: 35585 - protein, 43 aa, Zea mays
  misc_feature: Ceres CLONE 1415148-F
  misc_feature (2)..(2): Xaa is any aa, unknown, or other
  misc_feature (23)..(23): Xaa is any aa, unknown, or other
MXECVNSCIPYECAADPSDRQGXCEKSTGASYVGVIVGSFSPG

SEQ ID NO: 35586 - DNA, 740 bp, Zea mays
  misc_feature: Ceres CLONE 1415150-F
  misc_feature: Encodes the peptide sequence at SEQ ID NO. 35587
cccgcggtggcggccgctctacactagtggatcccccgggctgcaggaattcgcacgagaccattacctagaacatcctaatcgaaaaacctctcactaccaccaccactgccccggatccataccagctgcagcagcagcgcgcgcgagctaccttcggtcgcacgatagatcgatcgatcgctcgcccatcatggcgcgcgaggagcaggcgctgctgtctacgcagatcgtgaaccgcggcgtggagccgtcggacacggacgccgtctcgccggccttctcggggagcgtgcgccgccgcctgctggatttcctgcagtcgctgaacctcaagtacgtgcgcctcgggtaccactatctcatcagccacgggtgtgtacctggccacccatccccgtcaatcgtgctggtgggcgggcgccgatcctgcgccacccccagcccacgaacagctggtggaacaaggagcgggcgggaggccaccttaagaccctcggcacccgggctcgccttcctccgccgtctctcgccttcctcatcggcccgtctacaaccatggcccagggcccagggctccgtgggacctccatctgacttttgcctgggtaataaagccgggccggacgaggctcacaggtggccccaagggcgggatttttaccgaccccgggcctgcgcaaggtccgccgaaagttccctaggagggacaggccctggggggtccaatcccgggtccc

SEQ ID NO: 35587 - protein, 182 aa, Zea mays
  misc_feature: Ceres CLONE 1415150-F
  misc_feature: SWISSPROT Homolog: EC 2.3.1.119 Icosanoyl-CoA synthase
MAREEQALLSTQIVNRGVEPSDTDAVSPAFSGSVRRRLLDFLQSLNLKYVRLGYHYLISHGCVPGHPSPSIVLVGGRRSCATPSPRTAGGTRSGREATLRPSAPGLAFLRRLSPSSSARLQPWPRAQGSVGPPSDFCLGNKAGPDEAHRWPQGRDFYRPRACARSAESSLGGTGPGGSNPGS

SEQ ID NO: 35588 - DNA, 684 bp, Zea mays
  misc_feature: Ceres CLONE 1415155-F
  misc_feature: Encodes the peptide sequence at SEQ ID NO. 35589
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaactagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaacctttctccctactctcagcaacaacaatttcttcccattcaccnactgtctacactgaaccctgctgctttattgcagcaccacaactactaccattcagccagctagctactgcctactctcagcagcaacatttctttcatttaaccaattcgcgcactgaaccctctgcttattccagcagc

SEQ ID NO: 35589 - protein, 128 aa, Zea mays
  misc_feature: Ceres CLONE 1415155-F
  misc_feature (125)..(125): Xaa is any aa, unknown, or other
MAAKIFSILMLLALSACVANATIFPQYSQAPIAALLPPYLPSMTASVCENPALQPYRLQLAIATSNLPLSPLFFQQSPALSLVQSLVQTIRAQQLQQLVLPVISQVALATFLPTLSNNNFFPFTXCLH

SEQ ID NO: 35590 - DNA, 778 bp, Zea mays
  misc_feature: Ceres CLONE 1415159-F
  misc_feature: Encodes the peptide sequence at SEQ ID NO. 35591
  misc_feature (216)..(216): n is a, c, t, g, unknown, or other
  misc_feature (229)..(229): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (260)..(260): n is a, c, t, g, unknown, or other
  misc_feature (263)..(263): n is a, c, t, g, unknown, or other
  misc_feature (283)..(283): n is a, c, t, g, unknown, or other
  misc_feature (292)..(292): n is a, c, t, g, unknown, or other
  misc_feature (358)..(358): n is a, c, t, g, unknown, or other
aagctggagctccccgcggtggcggccgctctagaatagtggatcccccgggctgcaggaattcgcacgagaccattacctagaacatcctaatcgaaaaacaacacaacgcttataatacttacaacaaaagataagcccacgaatcagtagatcgaggtcccgcccagtccagcaaaagcacacacggagatgtcccagctgagctctgctggncacatggctgcgnacgttctcctcattctcnnntcgctcgcagnagnaacggtgtcagctgaccaancagtctctngctgccagaatgacatagacgcactgtggcgcagctgcaagcagtttcgtccagagggaggggccnaagatgccttcgtccgaggactgctgcaaaacattcagggccttagacgggcacgcgttctggaatttgggactacgtcggcttccccggacgccaggaataaactaaaacttggaaaaggtggttcttcctttaccaaaagggggggggtcccccgtccccaggggtttgggaataaaagagaggaattgaaaagggtttgaattttgaaggggcacattttgtataaatttgccccggggggttttaaaattttttttgggaaaaaaaaagggggggcaccattgtggttcttttggggggttgaaaaaaaaaatggtggggtgtttttttccccaaaaaaagaagaagagaccctccccccccccaaaaaaaaaaatcgggggaagggcccccccaaaattttgtggtttgggggga

SEQ ID NO: 35591 - protein, 122 aa, Zea mays
  misc_feature: Ceres CLONE 1415159-F
  misc_feature (13)..(13): Xaa is any aa, unknown, or other
  misc_feature (19)..(19): Xaa is any aa, unknown, or other
  misc_feature (23)..(23): Xaa is any aa, unknown, or other
  misc_feature (24)..(24): Xaa is any aa, unknown, or other
  misc_feature (31)..(31): Xaa is any aa, unknown, or other
  misc_feature (34)..(34): Xaa is any aa, unknown, or other
  misc_feature (56)..(56): Xaa is any aa, unknown, or other
MSQLSSAGHMAAXVLLILXSLAXXTVSADQXVSXCQNDIDALWRSCKQFRPEGGAXDAFVRGLLQNIQGLRRARVLEFGTTSASPDARNKLKLGKGGSSFTKRGGVPRPQGFGNKREELKRV

SEQ ID NO: 35592 - DNA, 721 bp, Zea mays
  misc_feature: Ceres CLONE 1415170-F
  misc_feature: Encodes the peptide sequence at SEQ ID NO. 35593
  misc_feature (412)..(412): n is a, c, t, g, unknown, or other
  misc_feature (468)..(468): n is a, c, t, g, unknown, or other
  misc_feature (475)..(475): n is a, c, t, g, unknown, or other
  misc_feature (492)..(492): n is a, c, t, g, unknown, or other
  misc_feature (535)..(535): n is a, c, t, g, unknown, or other
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcaaaaagtgctagggtttcccccgtcttatcgcttcctcgttcccgcagccgccgcccaaaccctagcaaacccgtcctccgccatggccgacgaccactactcgtccaagcggaagtacgacgacccctcgccgccgccgcggcgcacggggttctcttctggcccgccgcctgcctcgccgcccgctggcggcgccccgtcgtacaacagcgttgcgccgccccccgatgagatccagctcgcgaagcagcgtgcgcaggagatcgcggcgcggatctttaacgccgcagaggccaagcgccctcgcgtcgacnacggcgacgatgacgtcggcggcttcgggtggaggaagtttcctgggtggcagcgntggtggntggtggtggccgcatcngggggcgcaggactgggcttctcgtcctctggccgggggtggncatggggcttctatcccaccgttatcttctcagagcagtgcaccacagtacttcatatgggtggacatcaggggtacagcaaaagattgaattcaaattggaaaggggtggntgttattattggaaaagctggggaaactatttaggtatatcaactttcatcaggagcaaagattcaggtacgga

SEQ ID NO: 35593 - protein, 166 aa, Zea mays
  misc_feature: Ceres CLONE 1415170-F
  misc_feature (78)..(78): Xaa is any aa, unknown, or other
  misc_feature (99)..(99): Xaa is any aa, unknown, or other
  misc_feature (119)..(119): Xaa is any aa, unknown, or other
  misc_feature (156)..(156): Xaa is any aa, unknown, or other
MADDHYSSKRKYDDPSPPPRRTGFSSGPPPASPPAGGAPSYNSVAPPPDEIQLAKQRAQEIAARIFNAAEAKRPRVDXGDDDVGGFGWRKFPGWQRWWXVVAASGGAGLGFSSSGRGWXWGFYPTVIFSEQCTTVLHMGGHQGYSKRLNSNWKGVXVIIGKAGETI

SEQ ID NO: 35594 - DNA, 691 bp, Zea mays
  misc_feature: Ceres CLONE 1415175-F
  misc_feature: Encodes the peptide sequence at SEQ ID NO. 35595
aaagctggagctccccgcggtggcggccgctctagaactagtggatcccccgggctgcaggaattcgcacgagaccattacctagaacatcctaatcgaaaaaagagctcggtacatagccaagcaaacaggctgcaaacgctcacgaaaccacgcgtttggtggggtcggcgaggctggtgcggtggtgcacgccggtaactctcctcgccgtccaaagaagctataaattccacccaatcgccgccccgcacgcaccacaccgccccgaccatcaccgacaccagcgcctaagccccccccaaacggcaggagacagcagcaggccggaggtctcctccttctacgcatccactgagttccttcctgcgcaaagtaaatccccagttctttcggccgctgccaagttttcgagtgttgctagccccgccagagttttcttctcccccgcagtcgaattgggcgagaagttgatgggaccgggggcacactggaaggttgtgtgagatcgcgaaggggaccgtgaaatcctgagagggctgcggtgattcggctgctcggctgtatgaactgtttcgtgaacctgggactcaactcgaactcgaaccactacgtcgcctgcctcctcatcttcctgctgcatttctccccccagttaaatccatccaattctaattcaactagtagttgg

SEQ ID NO: 35595 - protein, 42 aa, Zea mays
  misc_feature: Ceres CLONE 1415175-F
MNCFVNLGLNSNSNHYVACLLIFLLHFSPQLNPSNSNSTSSW

SEQ ID NO: 35596 - DNA, 655 bp, Zea mays
  misc_feature: Ceres CLONE 1415187-F
  misc_feature: Encodes the peptide sequence at SEQ ID NO. 35597
aagctggagctccccgcggtggcggccgctctagaactagtggatcccccgggctgcaggaattcgcacgagaccattacctagaacatcctaatcgaaaaatacgactccctccactcatcttttctcgttcacaacctctaaaattatccccctactcgccagtcgaacatggacctgtagcagacctggacggcatcggacacgacaggaaggcttaataaggcttcgtctccgtcgcaatggacgcggccccagcaagaagtcagtgacaccgtccgcttaggccggggtgaaggtccccgtcgggcggatctgacgatacctcaataagggccgccacgcgaagtgagtgggaactggcgccgccgtatacctcgccgccggcctggagtacctctccgtcgcttcatgtcagggcaagaatggcacctgagcgtgtctcactgctatgctaactactatgataactaagatgcaggacctgctgagctccggtgagactgaggagctcttctcttcatatgatgaaggttttgagagtcttgatgatatgcgcctacaacagaatcttctgagaggcatctatgcttatggtactgagaagctgtctgcaattcacgagagaggtattggtccctgtctgcaggtgtct

SEQ ID NO: 35597 - protein, 68 aa, Zea mays
  misc_feature: Ceres CLONE 1415187-F
MLTTMITKMQDLLSSGETEELFSSYDEGFESLDDMRLQQNLLRGIYAYGTEKLSAIHERGIGPCLQVS

SEQ ID NO: 35598 - DNA, 670 bp, Zea mays
  misc_feature: Ceres CLONE 1415189-F
  misc_feature: Encodes the peptide sequence at SEQ ID NO. 35599
  misc_feature (358)..(358): n is a, c, t, g, unknown, or other
aaagctggagctccccgcggtggcggccgctctagaactagtggatcccccgggctgcaggaattcgcacgagaccattacctagaacatcctaatcgaaaaaattcccgaaatcacccccgacactccccacccaagaacccctcgtccccacctcgccatgggcagcgccgccgcctcgccgccgccgtccgggaagctgacgcaggaagagctgaagcgcgtggcggcgcaccgcgcggtggagttcgtggagcccggcatgacgctgggcctgggcacgggctccacggcggcgcacgcgctggaccgcctgggcgactccctccgcgcgggcgcgctgcccgggggtggtcgncgtgcccacctccctcagacgggaggccacgcggcgcgcggcaggatcccgtctctcccgctcccggggggcaggatcgccctcctcatcgacggccgcgaagaggacgaacaggacctcaaccttcggaaagggccgcggcggatcggtgctccaaaagaaaatgatcgacgggggccaggaaccggtttccttgttaatgaacgaagagccctaaatttggggcaagccctagattgtgaagggcggccatccccgcccgaaggtgaacctgttcggcgggggagactgacgctgggcatcaaaccccgc

SEQ ID NO: 35599 - protein, 170 aa, Zea mays
  misc_feature: Ceres CLONE 1415189-F
  misc_feature: SWISSPROT Homolog: EC 5.3.1.6 Ribose-5-phosphate isomerase
MGSAAASPPPSGKLTQEELKRVAAHRAVEFVEPGMTLGLGTGSTAAHALDRLGDSLRAGALPGGGRRAHLPQTGGHAARGRIPSLPLPGGRIALLIDGREEDEQDLNLRKGPRRIGAPKENDRRGPGTGFLVNERRALNLGQALDCEGRPSPPEGEPVRRGRLTLGIKPR

SEQ ID NO: 35600 - DNA, 760 bp, Zea mays
  misc_feature: Ceres CLONE 1415190-F
  misc_feature: Encodes the peptide sequence at SEQ ID NO. 35601
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (22)..(22): n is a, c, t, g, unknown, or other
  misc_feature (25)..(25): n is a, c, t, g, unknown, or other
  misc_feature (29)..(29): n is a, c, t, g, unknown, or other
  misc_feature (44)..(44): n is a, c, t, g, unknown, or other
  misc_feature (760)..(760): n is a, c, t, g, unknown, or other
nnnncccccccccccccccccntanctgngggatggggggcatnttttccaagctggtgctccaccgcggtggcggccgctctagaactagtggatcccccgggctgcaggaattcgcacgagaccattacctagaacatctaatcaaaaaattgaaattcccacgcgcccgtcgtttgccaccttccccaccagcaccaagcggcgagagcgggacggggcagagcaagagctagggataaccctcgcccaccatggcgacgcccggcgagcagcaggcaccggctgcggcggagtaggtcgtgtccgtcgagatgcctgcacccgacgggtggaccaagaagtttactccccagagagggggaagatccgagattgtttttgtttcgccaactggcgaggaaattaagaacaagaggcaactaagccaatacctaaaggcacaccctggaggccctgctgcttcagattttgattggggaactggtgataccccaaggcgttctgctcgcattagcgagaaagtcaaggtttttgatagcccagagggcgagaagatcccgaaacgcagcaggaactccaggggtaggaaggggtaggcaggggaaagaagggaagccccctgaaactgaaagaagccaaagatggctgaaacccggccaaggacgcccccaaagtgaagattggcacaaagggagacctgaacgttggaagattgaaacccttgctgaaaaaagggcgaaagggaaggctccctacn

SEQ ID NO: 35601 - protein, 94 aa, Zea mays
  misc_feature: Ceres CLONE 1415190-F
  misc_feature (1)..(63): Pfam Name: MBD Pfam Description: Methyl-CpG binding domain
MPAPDGWTKKFTPQRGGRSEIVFVSPTGEEIKNKRQLSQYLKAHPGGPAASDFDWGTGDTPRRSARISEKVKVFDSPEGEKIPKRSRNSRGRKG

SEQ ID NO: 35602 - DNA, 687 bp, Zea mays
  misc_feature: Ceres CLONE 1415191-F
  misc_feature: Encodes the peptide sequence at SEQ ID NO. 35603
  misc_feature (511)..(511): n is a, c, t, g, unknown, or other
  misc_feature (601)..(601): n is a, c, t, g, unknown, or other
aagctggagctccccgcggtggcggccgctctagaactagtggatcccccgggctgcaggaattcgcacgagaccattacctagaacatcctaatcgaaaaactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgtacggccgaggaaagagagcgccgcgagcagaaggccgagacgaagactcgcccgcgaccgggacggnccaagcgccgccgcgaccccgggagcgaggaatgagagcccgaagagctagagctgcaaacggaggatccccgtgagggagagatcacgnaggcggtgcccgtagctgtaggggacccgtgtcagatcactgggcaggggaagaagcagaagaacactatgcttccttcgagtacg

SEQ ID NO: 35603 - protein, 110 aa, Zea mays
  misc_feature: Ceres CLONE 1415191-F
  misc_feature (100)..(100): Xaa is any aa, unknown, or other
MGRRRRFAQLDDDDDDDEDVPINFKPSGGASSSDAKPRKPQPPPQQRRGVSDDDDEDVEEVELEEEEDDEKDLEAMRTAEERERREQKAETKTRPRPGRXKRRRDPGSEE

SEQ ID NO: 35604 - DNA, 719 bp, Zea mays
  misc_feature: Ceres CLONE 1415283-F
  misc_feature: Encodes the peptide sequence at SEQ ID NO. 35605
  misc_feature (704)..(704): n is a, c, t, g, unknown, or other
agagctggagctccccgcggtggcggccgctctagaactagtggatcccccgggctgcaggaattcgcacgagaccattacctagaacatcctaatcgaaaatggagaaatctggacagaatgctcatatattgttgtctatgttagtcaagcatcttgaacacaagaatgtattgaaacaaccagatatgaatctagatatcattgaagttacttcacgccttgctgaacactccaaagctcagtcttctatagcactaatgtcttcaataagtgatatggtcaggcatatgggtaaaagcatgcaatccttggccagtgatgcaggtcctggagacaacatggtcaaatggaatagcagatatgggaaagctgtagatgaatgtcttgttcagttgtctagaaaggtcggtgatgctggacctatccttgatacgttagctgtagtactggaaaatatttcgagttctatgattgttgcacggtctactatctctgcagcatatcgcactgctcaaatagttgcatcattgccaaacttgtcacatcagagcaaagcatttcctgaggcgttgtttcatcaacttcttttagcaatgctctatccagattgtgagacacatttaggagcacatcggattttctctgttgttcttgttccctcttccgttgctccgttttcatttgcagacacttcacagacnaggaagattgatctc

SEQ ID NO: 35605 - protein, 206 aa, Zea mays
  misc_feature: Ceres CLONE 1415283-F
MEKSGQNAHILLSMLVKHLEHKNVLKQPDMNLDIIEVTSRLAEHSKAQSSIALMSSISDMVRHMGKSMQSLASDAGPGDNMVKWNSRYGKAVDECLVQLSRKVGDAGPILDTLAVVLENISSSMIVARSTISAAYRTAQIVASLPNLSHQSKAFPEALFHQLLLAMLYPDCETHLGAHRIFSVVLVPSSVAPFSFADTSQTRKIDL

SEQ ID NO: 35606 - DNA, 652 bp, Zea mays
  misc_feature: Ceres CLONE 1415288-F
  misc_feature: Translation starting site: 165
  misc_feature (291)..(291): n is a, c, t, g, unknown, or other
  misc_feature (334)..(334): n is a, c, t, g, unknown, or other
  misc_feature (335)..(335): n is a, c, t, g, unknown, or other
ggagctccccgcggtggcggccgctctagaatagtggatcccccgggctgcaggaattcgcacgagaccattacctagaacatcctaatcgaaaaatcgcacaaatcctcttcctcgagttctcctcaaccaaattcaaagtcacagcggcgaaactctcggcgatgtctggccgcggcaagggcgggaaaggtctgggcaagggcggcgccaagcgccacccgcaggtgctgcgtgacacatccagggcatcaccaagccggcgatccgcaggttggcgaggaggggcgncgtcaagcgcatctccgggctcatctacgaggagaccccgcgnngtgctcaagatctccctcgagaacgtcatccgcgacgccgtcacctacaccgagaacgcccgccgcaagactgggaccgccatggaacgttgtctaaccctcctcaaagggcccagggggccccccccccccctctaaggggttttttgggggggtaatataccccccccccctccccccccccccggggggggggaaagaaaaaaaaaaatgggggagggggggggggggggacccccccccacccctaacagaacaaagtttctttttttctttcccacaccaactataaaaaacaaatacacgtggctgttgtt

SEQ ID NO: 35607 - DNA, 653 bp, Zea mays
  misc_feature: Ceres CLONE 1415290-F
  misc_feature: Encodes the peptide sequence at SEQ ID NO. 35608
  misc_feature (492)..(492): n is a, c, t, g, unknown, or other
  misc_feature (557)..(557): n is a, c, t, g, unknown, or other
  misc_feature (560)..(560): n is a, c, t, g, unknown, or other
  misc_feature (563)..(563): n is a, c, t, g, unknown, or other
  misc_feature (564)..(564): n is a, c, t, g, unknown, or other
aagctggagctcaccgcggtggcggccgctctagaactagtggatcccccgggctgcaggaattcgcacgagaccattacctagaacatcctaatcgaaaagcgattaatcaactccgccacgaccaacacgtacgtaaccagcggcggttcggcagcatgcggcgacgacggtgtccgctcctcgccgccgtcctcttcctcctccccctcttccaccgccaccacgccgccagcggcaccgacacggacacggtcacgctggccgcgccgctcatggggaaccggacgctggtgtccgccggcagcgccaagtacgtgctgggcttcttcgcgccggacccggacgccacgggatcaggacgggcgtacctcgggatatggttcaacggcatccccgcgcggaccgtcgtgtgggtgggcaccgcgagagccccgtcctgggcagcgtgggcgccgccgcgctcagggtcctcgccaacgggagcctggncatcgtcgtcgtggacgagaccgactacgaccacgaccagcagcccgtggtctgggcgacgccgncgncgnncacgtccagcggaagcaacgccaccgggcaggttctggaaaaagggaaccttcctgctgcgggtcccgggcgcccggcgggggggggaa

SEQ ID NO: 35608 - protein, 165 aa, Zea mays
  misc_feature: Ceres CLONE 1415290-F
  misc_feature (112)..(112): Xaa is any aa, unknown, or other
  misc_feature (136)..(136): Xaa is any aa, unknown, or other
MRRRRCPLLAAVLFLLPLFHRHHAASGTDTDTVTLAAPLMGNRTLVSAGSAKYVLGFFAPDPDATGSGRAYLGIWFNGIPARTVVWVGTARAPSWAAWAPPRSGSSPTGAWXSSSWTRPTTTTTSSPWSGRRRRRXRPAEATPPGRFWKKGTFLLRVPGARRGGE

SEQ ID NO: 35609 - DNA, 696 bp, Zea mays
  misc_feature: Ceres CLONE 1415293-F
  misc_feature (430)..(430): n is a, c, t, g, unknown, or other
  misc_feature (431)..(431): n is a, c, t, g, unknown, or other
aagctggagctccccgcggtggcggccgctctagaatagtggatcccccgggctgcaggaattcgcacgagaccattacctagaacatcctaatcgaaaagggcctccgaacctcttctgctctcccccacctcctggtccggcagtagagagcggggtcgcagagagatcgatatccggaggccgcgactgggagcgccaccaccatcgactgcgacaatggcgcccacgttgacggtcccggcttcgtcgaccacctcacgccgctgttctatgacgagctcgacatcgtgatcccgatgatcggcatcatcgacttcctgaagatgtggcggatcttcatgcagccctagcacctcatcatcgagcaggacggcgaccccgaccaagaccatcaaggtgcccgagggcttcgactactagctctacnnacggacgacatcacacgtatccttcggcccaggactcatgcatctcattctagactccgactgtcgctgcttcgactacatggtctcaaagaagagtacgtctacactatcgacgacgactgcttctttgccagggcctcatctggcaggatatctatgttcttgagcagacatcaagaaactgcgtcagccatcagcccgtttctcttcacaccctggacgaccccaacggtgaggtgttgactttgggcgtgatacccctccg

SEQ ID NO: 35610 - DNA, 699 bp, Zea mays
  misc_feature: Ceres CLONE 1415298-F
  misc_feature: Encodes the peptide sequence at SEQ ID NO. 35611
  misc_feature (218)..(218): n is a, c, t, g, unknown, or other
  misc_feature (291)..(291): n is a, c, t, g, unknown, or other
  misc_feature (352)..(352): n is a, c, t, g, unknown, or other
  misc_feature (355)..(355): n is a, c, t, g, unknown, or other
  misc_feature (356)..(356): n is a, c, t, g, unknown, or other
  misc_feature (393)..(393): n is a, c, t, g, unknown, or other
  misc_feature (534)..(534): n is a, c, t, g, unknown, or other
  misc_feature (577)..(577): n is a, c, t, g, unknown, or other
  misc_feature (589)..(589): n is a, c, t, g, unknown, or other
  misc_feature (592)..(592): n is a, c, t, g, unknown, or other
  misc_feature (699)..(699): n is a, c, t, g, unknown, or other
ggagctccccgcggtggcggccgctctagaactagtggatcccccgggctgcaggaattcgcacgagaccattacctagaacatcctaaaaaaaaccttaatcctatactttcatcgggcgcggcgtgccccctcgcctccaaggctccaacgcatcaatcaatagagcgagcgcgctgtggcatggagcacaaggatgggggcacagcttctgctgntggtctgcccgcggaagcagcttgtgctcgggctcgccgttgctcgacgcgccgatcctccgcccgctctacngcgggcaaatctttgcagatggggcgcgagacatcctctctcgtggtgctcggtcccgtgntgnngacgctcgttggaagggccacataccttcaggttttngggcatctggctgctgtcgcaaagcatatccttgatttgtcgctgaacccctcgtgaccaccctgctcatgtatgccaacctgagagccacaagcttccccggcattcatggcgctggtcgccgttaccaacgtctccggngctctagctgccctctcagctctcgcgggcaccatactgatcnagagagaatggntgntgataatctcaagcgggcatcttcccgtcgtgcgggaggggatcaactcggtggtcccgggaatcaacttgggctgtcgctgctggccccccgggtggcgctctcgn

SEQ ID NO: 35611 - protein, 66 aa, Zea mays
  misc_feature: Ceres CLONE 1415298-F
  misc_feature (26)..(26): Xaa is any aa, unknown, or other
  misc_feature (30)..(30): Xaa is any aa, unknown, or other
  misc_feature (31)..(31): Xaa is any aa, unknown, or other
MALVAVTNVSGALAALSALAGTILIXREWXXIISSGHLPVVREGINSVVPGINLGCRCWPPGWRSR

SEQ ID NO: 35612 - DNA, 701 bp, Zea mays
  misc_feature: Ceres CLONE 1415299-F
  misc_feature: Encodes the peptide sequence at SEQ ID NO. 35613
  misc_feature (363)..(363): n is a, c, t, g, unknown, or other
  misc_feature (373)..(373): n is a, c, t, g, unknown, or other
  misc_feature (387)..(387): n is a, c, t, g, unknown, or other
  misc_feature (400)..(400): n is a, c, t, g, unknown, or other
  misc_feature (436)..(436): n is a, c, t, g, unknown, or other
  misc_feature (472)..(472): n is a, c, t, g, unknown, or other
  misc_feature (473)..(473): n is a, c, t, g, unknown, or other
  misc_feature (514)..(514): n is a, c, t, g, unknown, or other
  misc_feature (534)..(534): n is a, c, t, g, unknown, or other
  misc_feature (651)..(651): n is a, c, t, g, unknown, or other
  misc_feature (701)..(701): n is a, c, t, g, unknown, or other
tggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcgncgctgctggnggagcgcgtggcgntgaagctcagggngtacttcgaccctcgcaaagaggagatcgacaaggncgtgcgcgctgaggagtgggggctccccgacgaggnncacgcgcactaccgcaacgcgatgcgggtcatgctcgaggncaaggccgcgcgcgtccccngatgcgtctccctcagcgagagggggcaggtcagggtgtaccaggagaagatcgccaagtggcaagcccaggtcgaggagcggctcagagtgcttggtcagagaagcggtgaggggnccactgctgcaaaagtgcccaagaaggtgctgcaaaacattctatcatan

SEQ ID NO: 35613 - protein, 147 aa, Zea mays
  misc_feature: Ceres CLONE 1415299-F
  misc_feature (36)..(36): Xaa is any aa, unknown, or other
  misc_feature (39)..(39): Xaa is any aa, unknown, or other
  misc_feature (44)..(44): Xaa is any aa, unknown, or other
  misc_feature (48)..(48): Xaa is any aa, unknown, or other
  misc_feature (60)..(60): Xaa is any aa, unknown, or other
  misc_feature (72)..(72): Xaa is any aa, unknown, or other
  misc_feature (86)..(86): Xaa is any aa, unknown, or other
  misc_feature (93)..(93): Xaa is any aa, unknown, or other
  misc_feature (132)..(132): Xaa is any aa, unknown, or other
MSFLRSLADSFSSLLFSSGGGAVSMDAAGAAPSPAXLLXERVAXKLRXYFDPRKEEIDKXVRAEEWGLPDEXHAHYRNAMRVMLEXKAARVPXCVSLSERGQVRVYQEKIAKWQAQVEERLRVLGQRSGEGXTAAKVPKKVLQNILS

SEQ ID NO: 35614 - DNA, 667 bp, Zea mays
  misc_feature: Ceres CLONE 1415301-F
tggagctcaccgcggtggcggccgctctagaactagtggatcccccgggctgcaggaattcgcacgagaccattacctagaacatcctaatcgaaaatccatccccgagacgacccaccacccacccctgcagactgcagcatccccttccccactcccggctggtctgctgcgatcacccctgcgccgatccacctccgctgattcctgccacaatatattctcccgcctcgtcgcctccgagccccgccacagaaggccttccaaaaccctccgacccctcaactccgctccgcaccgctccactctcctcctcccgggccggccgactgcaatggctgtaatcgaggctgctgcagccgactacgaccgtccgcccgatccaaggagaggcaccggatagcggacgcctgactctggaatcgacgactacgaccgcgagagaaatgaaactggacgtaaatgctcaccattgctgatcgacgtgtcggagaaagattatcctatccctctgtaaaactcccaaggcatgctaaaagtataatggcgttctgctcccaacatctaaaagtttcttaaacgagggatgactgttttttgtggtagaatctcctggaggctggcaaaagtttggctaactaacgtgacgtggaagtacgtgtactat

SEQ ID NO: 35615 - DNA, 709 bp, Zea mays
  misc_feature: Ceres CLONE 1415305-F
  misc_feature: Encodes the peptide sequence at SEQ ID NO. 35616
  misc_feature (367)..(367): n is a, c, t, g, unknown, or other
  misc_feature (379)..(379): n is a, c, t, g, unknown, or other
  misc_feature (476)..(476): n is a, c, t, g, unknown, or other
  misc_feature (545)..(545): n is a, c, t, g, unknown, or other
  misc_feature (578)..(578): n is a, c, t, g, unknown, or other
  misc_feature (623)..(623): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaactcgcatcagagcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattgncaaggctggtgntgacaagtgaaagtccctgtctgatgccgagaaggctccctacgtgtctaaggcagagaagctcaaggctgagtacaccaagaagatcgacgcttancacaaacagcagtctggagaccccacggcgtctggtgattccgacagtcccagtccgaggtgaacgacnaggacgaggagggtgacgagtgatgtatgacgnatgaaactctgtccaagtgtttgcagtcagggaaaaatctcgtcnngtgtcgccctacccggttttctcaaggactttctagatgcagagatagtgccgtctctgagtattccttgcaagtgcgtcccgtc

SEQ ID NO: 35616 - protein, 66 aa, Zea mays
  misc_feature: Ceres CLONE 1415305-F
  misc_feature (60)..(60): Xaa is any aa, unknown, or other
  misc_feature (64)..(64): Xaa is any aa, unknown, or other
MKSRARSTAGDSRLSVRKTKAEKDPNKPKRPPSAFFVFMEEFRKDYKEKHPNVKQVSLIXKAGXDK

SEQ ID NO: 35617 - DNA, 699 bp, Zea mays
  misc_feature: Ceres CLONE 1415313-F
  misc_feature: Translation starting site: 171
  misc_feature (237)..(237): n is a, c, t, g, unknown, or other
  misc_feature (311)..(311): n is a, c, t, g, unknown, or other
  misc_feature (330)..(330): n is a, c, t, g, unknown, or other
  misc_feature (331)..(331): n is a, c, t, g, unknown, or other
  misc_feature (336)..(336): n is a, c, t, g, unknown, or other
  misc_feature (339)..(339): n is a, c, t, g, unknown, or other
  misc_feature (342)..(342): n is a, c, t, g, unknown, or other
aagctggagctccccgcggtggcggccgctctagaactagtggatcccccgggctgcaggaattcgcacgagaccattacctagaacatcctaatcgaaaagcgaagcgcgaagccgcgaagcctcacctacagttccttcgcgcaccggcaccgcggcggcagttcagcatggtggcagcatccgtagccgagcgggcctatgagggcgcgacgcggtccgcgctggtggcgctgnagcgcaacctcatccccggacgcgtgacccggcgcctgacgcgtctcctgctcgcgcagcgcctccgccagggntacctcccctcccgcgcgnntcagntgnagnagctcctccagttcgtccactctcatgaagagatgcccattgccattgaaacagacaaagctaaagcccaacactatgagttgccaactacatttttcaagctagtggctggaaaagaatctcaaatacagttcctgctatttccctggtgattcaagcaccctagaagatgctgaaggtgcgatgatggatctgtattggggagagggccaaactacaagatggccaaagtatcctagatgttggagggggatggggatccttttccctggaacttggaaagaaatataggaacttggagggaaaaggggatatcaacctctactacccaaaagggtttttatagaaaaggcaggg

SEQ ID NO: 35618 - DNA, 709 bp, Zea mays
  misc_feature: Ceres CLONE 1415315-F
  misc_feature: Encodes the peptide sequence at SEQ ID NO. 35619
  misc_feature (312)..(312): n is a, c, t, g, unknown, or other
  misc_feature (328)..(328): n is a, c, t, g, unknown, or other
  misc_feature (340)..(340): n is a, c, t, g, unknown, or other
  misc_feature (341)..(341): n is a, c, t, g, unknown, or other
  misc_feature (365)..(365): n is a, c, t, g, unknown, or other
  misc_feature (391)..(391): n is a, c, t, g, unknown, or other
  misc_feature (412)..(412): n is a, c, t, g, unknown, or other
  misc_feature (476)..(476): n is a, c, t, g, unknown, or other
  misc_feature (518)..(518): n is a, c, t, g, unknown, or other
  misc_feature (524)..(524): n is a, c, t, g, unknown, or other
aagctggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcngtcggaggcggggcgntgtccatggacnngcgcggggcggccccgtcccccgnggcggtgccgggggagcgcgtggcgntaaagctcagggggtacttcnacctcgccaaagaggagatcgacaaggccgtgcgcgctgaggagtgggggctccccgacgaggncaccgcgcactaccgcaacgggatgggggtcatgctcgaggncaaggncgcgcgcgtccccgatggcgtctccctcagcgagagggggcaggtcagggtgtacaagaaaaagacgccaagtggcaggcccaggtcgaggagcggctcaaagtgctggtcaaagaagcgtgaaagggcccctgctgcaaagtgcccaagaagtttgctgaaaaaatcctatcttaggactgcaa

SEQ ID NO: 35619 - protein, 149 aa, Zea mays
  misc_feature: Ceres CLONE 1415315-F
  misc_feature (23)..(23): Xaa is any aa, unknown, or other
  misc_feature (27)..(27): Xaa is any aa, unknown, or other
  misc_feature (35)..(35): Xaa is any aa, unknown, or other
  misc_feature (44)..(44): Xaa is any aa, unknown, or other
  misc_feature (51)..(51): Xaa is any aa, unknown, or other
  misc_feature (72)..(72): Xaa is any aa, unknown, or other
  misc_feature (86)..(86): Xaa is any aa, unknown, or other
  misc_feature (88)..(88): Xaa is any aa, unknown, or other
MSFLRSLADSFSSLLFSVGGGAXSMDXRGAAPSPXAVPGERVAXKLRGYFXLAKEEIDKAVRAEEWGLPDEXTAHYRNGMGVMLEXKXARVPDGVSLSERGQVRVYKKKTPSGRPRSRSGSKCWSKKRERAPAAKCPRSLLKKSYLRTA

SEQ ID NO: 35620 - DNA, 687 bp, Zea mays
  misc_feature: Ceres CLONE 1415318-F
  misc_feature: Encodes the peptide sequence at SEQ ID NO. 35621
  misc_feature (405)..(405): n is a, c, t, g, unknown, or other
  misc_feature (414)..(414): n is a, c, t, g, unknown, or other
  misc_feature (430)..(430): n is a, c, t, g, unknown, or other
aaagctggagctccccgcggtggcggccgctctagaactagtggatcccccgggctgcaggaattcgcacgagaccattacctagaacatcctaatcgaaaataccgcctgatccaccgcggtttgcttgccgcgagcatggaaattattagtcattcgacaagtcagagagattttatttcctctcgtcgtctcgtggccgctggtgcccgcgcgtcagatttggcctgctccgctccgcctccgcagtgtgaatttctgagagataggtttctgtgctgcagacagcccggcggcgacgcggtggcagtttgcggcgaggtccggcgtcgcgccggcgttcatgtcgttcaggacggagggcgacggcgagggctctgagggcgtctcggtctccgagctccnggcggccgnagacgccttcgacggncatcagaagcagagctccatgctttcaatctacagcaagaggcagttggccacaacagcagccagggcacggaacagagcaataccctgcagggggcaaaggaagggttccaggggggggattacgggggggggaaccgatcgctccctggggggggggggggggaaatcaaataaagaacccgggtgtggggccccccctggggggttcctagggcaactgggtggggggggttctgggggggcgaagagttccca

SEQ ID NO: 35621 - protein, 114 aa, Zea mays
  misc_feature: Ceres CLONE 1415318-F
  misc_feature (21)..(21): Xaa is any aa, unknown, or other
  misc_feature (24)..(24): Xaa is any aa, unknown, or other
MSFRTEGDGEGSEGVSVSELXAAXDAFDGHQKQSSMLSIYSKRQLATTAARARNRAIPCRGQRKGSRGGITGGGTDRSLGGGGGKSNKEPGCGAPPGGFLGQLGGGGSGGAKSS

SEQ ID NO: 35622 - DNA, 685 bp, Zea mays
  misc_feature: Ceres CLONE 1415321-F
  misc_feature: Encodes the peptide sequence at SEQ ID NO. 35623
tggagctccccgcggtggcggccgctctagaactagtggatcccccgggctgcaggaattcgcacgagaccattacctagaacatcctaatcgaaaaagtgggatttggtgggagctgcgctgcagctgcttgccccctcgcgtttctttgctcaattgggggtgtcgcgcgtgctcgtgggcggaattcggtgttcttgcttgcgcggtccacgtccccgtccccgtccccatcccttggcgcgattgcggttgcggacgctcgctgcagatcttcgcgcgactccgggagcgccgccggagatggactgcgggccgcccgaccagctgccgccgtcgtcggcgccggcgtgcttcctcaacctcaactgggaccagtccatggccgccgccacggccggcgaccacctcgacctggtctcctccccggcgtccaactcgacggcggctgacggcctcgctctccacgggatctcgccgcagccgcagtacggaggcactccgctcagctcgccccgcaagctgaacctctcgatgatgggccagttccaccactacccgccgatgggccatctagaccagttcctcgccgacccaggcttcgccgcgcgcgcggcgaggctctccggcttcgacggcccgccccggtgggagtggctacggcggcgccgtcccgggacagttt

SEQ ID NO: 35623 - protein, 127 aa, Zea mays
  misc_feature: Ceres CLONE 1415321-F
MDCGPPDQLPPSSAPACFLNLNWDQSMAAATAGDHLDLVSSPASNSTAADGLALHGISPQPQYGGTPLSSPRKLNLSMMGQFHHYPPMGHLDQFLADPGFAARAARLSGFDGPPRWEWLRRRRPGTV

SEQ ID NO: 35624 - DNA, 696 bp, Zea mays
  misc_feature: Ceres CLONE 1415323-F
  misc_feature: Encodes the peptide sequence at SEQ ID NO. 35625
  misc_feature (501)..(501): n is a, c, t, g, unknown, or other
  misc_feature (614)..(614): n is a, c, t, g, unknown, or other
  misc_feature (618)..(618): n is a, c, t, g, unknown, or other
  misc_feature (644)..(644): n is a, c, t, g, unknown, or other
  misc_feature (683)..(683): n is a, c, t, g, unknown, or other
aagctggagctccccgcggtggcggccgctctagaactagtggatcccccgggctgcaggaattcgcacgagaccattacctagaacatcctaatcgaaaaaaccttttcgcagctccaggctccagcgcacagccgccgccgtttcttcatcttcttcgcagagccggcgctccatcttcggctccctcccttacttgcgctcggcacgcaggcggcggcggcggcgctgtggctcgggatctcagtgacggcatcagcggtttcccctcccgcctctcgccagtcgcctccggtcctccgcacaccggccggtgatctctctcctcccgcctccggtggatcgtcaacgacgcccggccccggcggctgcgccgcgcgcgtcctgagggcagctgcaggcgctgctccaccaaggcggtcgcgccgcttttggagcggtttatgcccccaaagtgaagcgtgctcttagtgccgctctttggaaccctggctactgctngttaatggctcacccttcagtcattctagcaactggcaagtatgatcacacaatcagattttgggaagccagaggcggtcgctgttaccgcactattcagtatccagactctncagntaatcgccttgagataacccctgacnagccggtcttaagctgctgctggccatcctcatatccgnccctttttgacgc

SEQ ID NO: 35625 - protein, 63 aa, Zea mays
  misc_feature: Ceres CLONE 1415323-F
  misc_feature (37)..(37): Xaa is any aa, unknown, or other
  misc_feature (38)..(38): Xaa is any aa, unknown, or other
  misc_feature (47)..(47): Xaa is any aa, unknown, or other
  misc_feature (60)..(60): Xaa is any aa, unknown, or other
MAHPSVILATGKYDHTIRFWEARGGRCYRTIQYPDSXXNRLEITPDXPVLSCCWPSSYPXLFD

SEQ ID NO: 35626 - DNA, 717 bp, Zea mays
  misc_feature: Ceres CLONE 1415324-F
  misc_feature: Encodes the peptide sequence at SEQ ID NO. 35627
  misc_feature (284)..(284): n is a, c, t, g, unknown, or other
  misc_feature (293)..(293): n is a, c, t, g, unknown, or other
  misc_feature (294)..(294): n is a, c, t, g, unknown, or other
aagctggagctccccgcggtggcggccgctctagaatagtggatcccccgggctgcaggaattcgcacgagaccattacctagaacatcctaatcgaaaaatcgcacaaatcctcttcctcgagttctcctcaaccaaattcaaagtcacagcggcgaaactctcggcgatgtctggccgcggcaagggcggtaagggtctgggcaagggcggcgccaagcgccaccgcaaggtgctgcgtgacaacatcccaggcatcaccaagccggcgatcccgcagttgncgaggaggnngcgcgtcaagcgcatctccgggctcatctacgaggagaccccgcgcgtgctcaagatcttcctcgagaacgtcatctgcgacgccgtcacctacaccgagcacgccccgcgcaagactgtgacccgcatggacgttgtctacgctctcaagcgcagggccgcaccctctacggtttcgggcggtaggtcgcccctctcccgtggcgaattacgtgtgggcggggcggccggggtggggtcttggctaagtagctggggtgccttaatcgggggtggttttcggggggggtggactgcatcgttcaagtttcaagccagggggctgaaaaatccccgtgcgggaaacaaggggaagcgcctcgttttcggcaaaaaaaaaaaaaaaaggttttccgtaccggccccccccggggggggggcccc

SEQ ID NO: 35627 - protein, 182 aa, Zea mays
  misc_feature: Ceres CLONE 1415324-F
  misc_feature (25)..(94): Pfam Name: Histone Pfam Description: Core histone H2A/H2B/H3/H4
  misc_feature (39)..(39): Xaa is any aa, unknown, or other
  misc_feature (42)..(42): Xaa is any aa, unknown, or other
MSGRGKGGKGLGKGGAKRHRKVLRDNIPGITKPAIPQLXRRXRVKRISGLIYEETPRVLKIFLENVICDAVTYTEHAPRKTVTRMDVVYALKRRAAPSTVSGGRSPLSRGELRVGGAAGVGSWLSSWGALIGGGFRGGWTASFKFQARGLKNPRAGNKGKRLVFGKKKKKRFSVPAPPGGGA

SEQ ID NO: 35628 - DNA, 703 bp, Zea mays
  misc_feature: Ceres CLONE 1415330-F
  misc_feature (338)..(338): n is a, c, t, g, unknown, or other
  misc_feature (339)..(339): n is a, c, t, g, unknown, or other
  misc_feature (406)..(406): n is a, c, t, g, unknown, or other
  misc_feature (505)..(505): n is a, c, t, g, unknown, or other
  misc_feature (511)..(511): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaaaccaacagccaatccacacctcgcttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatcgccgtcgcctccccttcgccgctattttccagtcgccgggatcagccgagttggatctcgaggcatannagcgttgcggcgcccggcgaggatacgatgcctgcggtgctcgccgcattcgctacccttcgagccngcgctgccatcgcctccggggactcctcctttccctggttccatcgtctcaagcatcgttttagtagtagtaattttagtagtagtaattgtcattaanctttgncgtccctccgtcgcgcacgctcctcggctcggtcctcaccttcgcatttcggttttggtctgggtgtgctcgatccgaggctttacttgggttttgcggcttctctccttgtcgaagcttggtgtctggattcnacctgcagatcggaaggaaccaaggtgtcattatcacctacagatagagaaattctct

SEQ ID NO: 35629 - DNA, 704 bp, Zea mays
  misc_feature: Ceres CLONE 1415333-F
  misc_feature: Encodes the peptide sequence at SEQ ID NO. 35630
  misc_feature (634)..(634): n is a, c, t, g, unknown, or other
aagctggagctccccgcggtggcggccgctctagaactagtggatcccccgggctgcaggaattcgcacgagaccattacctagaacatcctaatcgaaaaccttttgggagacacggacgagagctctagtctgcactccgcaggcaggcaagcacgcaaagctgccggagtcctgagatggcggcgacccttcccgttccctacgccctacggctacgcgctcctcttcccatgtcgcggcgaattccccgtaagccatcattcccctgtaacagggcatgccgcgccggcgtccgctgctccgccgcaaacaagccctcccctcctcccccgaccactccggatagcagcgagctccattgcgaagatacggagtgaggtcctctccccgttccggtcggtgcggatgttcttctacctcgcgttcatggccagcggcacgctggggggcctcatcgcgctcacgcggctcctcccggcgctgtccggctccgactccgcgagcgcggacagcacgctcaagggcctgggcatcgacgtcgcggacgtctcgctcttcgccttcctctactcgcgcgagagcaaggccaaggacgcccaggtggccaggctcgcgagggaggagcgcctgntcaggctcaggctccggctccgcgcccgcgacgtcgagggcgcgggtagcaacagggcgttcacgctcgg

SEQ ID NO: 35630 - protein, 98 aa, Zea mays
  misc_feature: Ceres CLONE 1415333-F
  misc_feature (76)..(76): Xaa is any aa, unknown, or other
MFFYLAFMASGTLGGLIALTRLLPALSGSDSASADSTLKGLGIDVADVSLFAFLYSRESKAKDAQVARLAREERLXRLRLRLRARDVEGAGSNRAFTL

SEQ ID NO: 35631 - DNA, 840 bp, Zea mays
  misc_feature: Ceres CLONE 1415345-R2
  misc_feature (1)..(1): n is a, c, t, g, unknown, or other
ncccgattgggtaccgggccccccctcgaggtcgacggtatcgataagcttttttttttttttttttgggaaagatgggtttctgtatttgatgggttcttacgattctgctggccacgtcagtgctacatatgatcccgtcagctcggcgagggacaagattaagggacgggactacaccgcacgtgtgaaatcggactgacggtgggcacggatggcgaaggcgaaaacactggccctggttctgtgagttccttgatccttaccactctatattttgccaccttgggattggatacatacctgtcggggggctgatgtcttgatcccgctcatgcgcgcggcgagagcttagggacatgctttggacctgacctcgcacaatgcgtcggtccggacgacttagcaaaattctcatccataactcccctgctaccacgaagccaggctctttcgctcttcgtctcatgctgcgcttcataagctgaccacttggctctcgcccgcgtgcatgcgactgagggtgtcgccgggccattcctttcctccttgaacagggtctgctgcggctgccgggccgccctctgcgagatcaccgaccgcacgctctcagccgtggcgtgtgaacctcccgcagcgaatgtcctcggagcgctgccgtggctgtacgccgaggcggaacgcgccgctctataccacggtcaaggccgcgttgactcccggtcgctgatcatgtcgagctcaacatccgcaacagctctgccgacaaggggtcactggagcctcacgctcgctgttgtagctgacgcggggagagcgtgatcgggggtcacgcggcgg

SEQ ID NO: 35632 - DNA, 863 bp, Zea mays
  misc_feature: Ceres CLONE 1415345-R
  misc_feature: Encodes the peptide sequence at SEQ ID NO. 35633
  misc_feature (1)..(1): n is a, c, t, g, unknown, or other
  misc_feature (2)..(2): n is a, c, t, g, unknown, or other
nnaaaaagggaactgttatgatgggttattctatactgttggcaacatcaatacaacatatgatcccatcacctccgcagggaagaggattaagctacgggactacaccaaatgtaggaaatagtactgacaatgggcaggtatggtgaaggcgaaaacactggcccaggtacggtaagttctttgatagttaccatatatattttgcaactttgtgatagtagatgaaacatgtaggggggctgatgttttgttcgctcaaatgtgtgtggcatagtattgtaccctcactttggacctccatatgcagtatgtgtggcacggaggaagttgcaaaatccacctgatttctatgtggagttccacatatatgaagccatttgcgcgacgatgaagatgtgcggttcttcacctcagtcatgttctcttaaagggggcaaagagaatcgatggagttgtgccgaccaaatcctaatgacttggacagcgcctccttcagttgacagtgtctgcttctgtgacgataccaagacgcccactctcacggtgtgctctgaattttctaaatgcaaatgtgcatggacccctccagttcttatacctcgaagagaaacgactgcttctattccaccagcagctcctataagatgcccagtcattgatttggtcgagttcaccctcagttgagggttctggcgaaaacagcgcacgatagcctcatactccttcaagtcacctgcttgtgtagatgttggatgggcattcacgcaggttgatttctgcccctgctacccctgcatcggctaatggcttgcggatgcgtacatgaatccctccccccctagggatggggttcagccacg

SEQ ID NO: 35633 - protein, 39 aa, Zea mays
  misc_feature: Ceres CLONE 1415345-R
KGNCYDGLFYTVGNINTTYDPITSAGKRIKLRDYTKCRK

SEQ ID NO: 35634 - DNA, 863 bp, Zea mays; identical to SEQ ID NO: 35632
  misc_feature: Ceres CLONE 1415345-R3
  misc_feature: Pfam Name: Ketoacyl-synt_C Pfam Description: Beta-ketoacyl synthase, C-terminal domain
  misc_feature: SWISSPROT Homolog: EC 2.3.1.41 Beta-ketoacyl-acyl-carrier-protein synthase I
  misc_feature (1)..(1): n is a, c, t, g, unknown, or other
  misc_feature (2)..(2): n is a, c, t, g, unknown, or other

SEQ ID NO: 35635 - DNA, 871 bp, Zea mays
  misc_feature: Ceres CLONE 1415355-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (38)..(38): n is a, c, t, g, unknown, or other
  misc_feature (39)..(39): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (700)..(700): n is a, c, t, g, unknown, or other
nnnnnnnnnnnnnnnnnnnnnaaacccccccccaaccnngcaaaaaaannantaaaaactggggctccaccgcggtggcggccgctctataactagtggatcccccgggctgcaggaattcgcacgagaccattacctagaacatcctaatcgaaaagaaaagcccattccgctcatcactgaacaacccccggcggcaaccctccccacagatggccggcgaacccagcggcgccgtgggatcggggcccgaatccgcggccgaggacgaccgcctcctggagctggccgagtagtaaatctccgcgggcaggctgcaagccgcgcgcaggatcgccatccgcgcgcgccgcctgaacccgacctcgacgcgcgacccgggggtggccaacgccgaaaatattgttcatacaataaagccctcctccctccacggtcgggcttgctgtgtgcactcacccctgactaccacctgaaccccttcggccgactgccccatcctcccgagcaccgcgccagaaaaagttaaaaggatcgccctacgcgcatggtccccctcccggcactaccggaaattaccaaagagagagacccaacgcgaaatgatcgaaacaaacaccaccttccagttaaagccggccaacacaaaccgaaaaaatagctcatcattacggctcttgggggcctaaccttaggcgtnctttaagtacaggcccccccaaccggtccaatcagggataatagcggcccaaacccataatggggaacccgtcccctggcagaccggtcgaaagaaccatcccctgaaccagcgaagccagatggatagagaccaacaccgccgcggaggtaccttctcacacgacacccc

SEQ ID NO: 35636 - DNA, 665 bp, Zea mays
  misc_feature: Ceres CLONE 1415361-F
  misc_feature: Encodes the peptide sequence at SEQ ID NO. 35637
  misc_feature (512)..(512): n is a, c, t, g, unknown, or other
aaagctggagctccccgcggtggcggccgctctagaactagtggatcccccgggctgcaggaattcgcacgagaccattacctagaacatcctaatcgaaaaaaaaatatgataacacatcaattgccagtcgtcgtccccaccgctggccgcgcggaagcccgcgaagatgtccctcggcgggaccagcggcccgcgcgtctgcgcccggatctgcaagctcgccggacgccgccagcggatgctcctccgcctcctcgtctccgtcgccgtggcattctgcttcctcttctcatcacttgtcagtaaagacgaagatgcatcacctggtgttgagaccatgcttgtgttttctgatcatgtccggagctttgtgaaccctgtttggacatcgtcaggcagaccagttgatagaaaacgcactggaccacgaccttgtccagtttgttatttgccagttgagcaagcactggcactgagaccagctaaaccatcattgtcaccagtccttncaagcttaaattatgttcttgaagagattttgattcctaaagagtccaagagcggttctttgtttggaggttttccatccctggaggaacgagataagtcttatgacataaaagactcgatgagtgtacattgtggatttgtaagagggacgg

SEQ ID NO: 35637 - protein, 165 aa, Zea mays
  misc_feature: Ceres CLONE 1415361-F
  misc_feature (115)..(115): Xaa is any aa, unknown, or other
MSLGGTSGPRVCARICKLAGRRQRMLLRLLVSVAVAFCFLFSSLVSKDEDASPGVETMLVFSDHVRSFVNPVWTSSGRPVDRKRTGPRPCPVCYLPVEQALALRPAKPSLSPVLXSLNYVLEEILIPKESKSGSLFGGFPSLEERDKSYDIKDSMSVHCGFVRGT

SEQ ID NO: 35638 - DNA, 674 bp, Zea mays
  misc_feature: Ceres CLONE 1415370-F
  misc_feature: Translation starting site: 330
  misc_feature (428)..(428): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaagagcagagctgcctccagacgagacgaggaggacgcggcgccgctcgggcttggcagcaaccagcgtcgagcgcagtgcccttctgtctcctatctccccgctgcccagccgggtctcactttccagtctccgagactctgagtctcgctcgcaccccgtcccccgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggnctgctcagcaatggtgactttgagacagcaccaagtgggtgggtttgtaaaatctgcgtctgttgctgagggtgcatcgtcaatccctgggtggacgatcaacggcacggttgaactcatttcagcaggccaacaccagggtgcatgatcctgattgtcccacagggggacatgcagtaggctagggatgatgctagcgttggcgggtggtgacctttaaaaagggntcggagtatgctatcactt

SEQ ID NO: 35639 - DNA, 712 bp, Zea mays
  misc_feature: Ceres CLONE 1415373-F
  misc_feature: Translation starting site: 203
  misc_feature (226)..(226): n is a, c, t, g, unknown, or other
  misc_feature (280)..(280): n is a, c, t, g, unknown, or other
  misc_feature (358)..(358): n is a, c, t, g, unknown, or other
  misc_feature (360)..(360): n is a, c, t, g, unknown, or other
  misc_feature (562)..(562): n is a, c, t, g, unknown, or other
aagctggagctccccgcggtggcggccgctctagaactagtggatcccccgggctgcaggaattcgcacgagaccattacctagaacatcctaatcgaaaaagctctactcctctccccgagtcctctcctctccggggtattgaattcgaaccaaaaaatcaaaacaactcagcgattcgattcgcggcgagtcaagcgggatgccgccgcgcacggctccgcgncgacctcacccccgcgcggaaggtgccctccggaagctgctgcgtgcggcgtcngtcgcctgcggggtgcagttcggctgggcgctgcagctgtcgttgctgaccccgtacgtgcaggaggttgggaatccngnacgcctttgccagtctcgtgtggttgtgcggtcggttgtccgggctccttcgtcagcccctcgttggccacctctccgaccggatcggcccccgccgtttcgccgctcgggcgccgcaggccttcatcgccgcccggggccgggtgaatcgccgagcccgtggtcaccgtcgtttcctccgctgacctcgggcgacttttcngggacgaaggcacccccgggtacacgggcctcggggcatttgggttaactttgaggatctggctggtccaccgggcaaaaccggccccagggccctggaggctttcctccgcgaccccaagaaatgaccaggggggattgatccttatgt

SEQ ID NO: 35640 - DNA, 795 bp, Zea mays
  misc_feature: Ceres CLONE 1415378-R
  misc_feature: SWISSPROT Homolog: EC 2.7.11.1 Non-specific serine/threonine protein kinase
ttccgattgtgtaccgggccccccctcgaggtcgacggtatcgataagcttttttttttttttttttggatccctaataaaaaagctccatttatatatgttcattcacagatcttactgacgtgtgacaaggagagatgaagaaagcttcatctgaaagaagataagaaaatctgccttctcccatatgcacacagcatattccactggcgaagctatgagggaaaacctctgtcttctaccatcaacaaaggaatgctgagctctaccaagagacttcctatggtatgccctcccaatgattgctcctacgagcattttgactccgaatctgctggtacctgctaccactcaccccctggggaagtgcaccacgagcactttctcgcatatcagtggccttgttactccttctactgccttgtcttctttcacggtcgtcttctccacatcggataaacatgcatcttctgtgccacgccgaagtctgtgactccaatgtcgaactggcctgcatctccttgatcattgccatgaccttcaccgttgtcggacgcttctaccgtatgtcgtcctagcgtgcacaagcaacttttacgtgctcctggatgtcgagctccagggcctgatcttccttcacgagctgaagatcggacagatccgtgagcctcgacttcaagtgctgcttgacccatcctacaatattggtgtcgctcccacagtctcgtcgagctgcagagctggtcccagtgagcagatcgaggataccagaccttgctatacacatcgtacatg

SEQ ID NO: 35641 - DNA, 702 bp, Zea mays
  misc_feature: Ceres CLONE 1415378-F
aaagctggagctccccgcggtggcggccgctctagaactagtggatcccccgggctgcaggaattcgcacgagaccattacctagaacatcctaatcgaaaaagtaccgcatctccaccaaggaccggatcctgattttgactcccaactgggctataggccaacctgagaggaacgaaggaggtcgctcactgacaggatgtctctgcccgtgacgctgtcctcgctgggacgaccgatacgacgaaaacgagtgtcctcagtcgacctcctctcctccacgccatgccgcagaattactacaggccgacgaactgctgccccaacgcgttcctcacccagatagaggcacatgcgattgatgacgacgacgtgccaagatatgcgctgcctgacatgattgattacaacgtcagcgcctacgagctccgatgccgcaggcacctcacagcgaccagagcatcctctattttcgcctagaagtactgatacagccagagctgatctgatctttgctagcttgcaggcatccccaatctgaagatatgcttcgctatactggccatgttcctaggattaatctccctcttctacctacacaacatttcagatatctttcttgcatggccttacattatgagctacctagattcacttttccagcttgcagagtatgctctccatcatgaacatgtcggacat

SEQ ID NO: 35642 - DNA, 686 bp, Zea mays
  misc_feature: Ceres CLONE 1415484-F
  misc_feature: Encodes the peptide sequence at SEQ ID NO. 35643
  misc_feature (241)..(241): n is a, c, t, g, unknown, or other
  misc_feature (287)..(287): n is a, c, t, g, unknown, or other
  misc_feature (369)..(369): n is a, c, t, g, unknown, or other
  misc_feature (370)..(370): n is a, c, t, g, unknown, or other
  misc_feature (389)..(389): n is a, c, t, g, unknown, or other
  misc_feature (390)..(390): n is a, c, t, g, unknown, or other
aaagctggagctcaccgcggtggcggccgctctagaactagtggatcccccgggctgcaggaattcgcacgagaccattacctagaacatcctaatcgaaaatcatcacactcgaaaacccaacagcttccttcctggcgatccaattaacggcttctcttctgagctcagcacgaacaatggccaccatcctcaccgtcgcaagcttcttcgcacttgtgtgcatctctcaacaagcgcnggctgcgaactacacgttcatgaaggacgcggtgcacgcgccgcgnacgggcttctacgactacatcatagtcggcggggggaacggcgggctgcccgctggcggccaccctgtcggcccccccgcgnntgctgctgctgaaccccgnncctctccgtacgaagacccggcggtctgaaaatgccccctttcccggagggggtgggggacccgtcggggtctcccccgccgaaaggtttgtgtcgaaggacgggtgaccattcccccccgcggggggtgggggggggaaattgaataaacgcccgttttttacccgcggccgggcgggttaaaataagggccccccggtggaaccccagggagggggggcgcgcaaaccggggaggaaagagagttcccctcccccccggcttggcccccggaaaccccccgggagtggcccctt

SEQ ID NO: 35643 - protein, 79 aa, Zea mays
  misc_feature: Ceres CLONE 1415484-F
  misc_feature (21)..(21): Xaa is any aa, unknown, or other
  misc_feature (64)..(64): Xaa is any aa, unknown, or other
  misc_feature (71)..(71): Xaa is any aa, unknown, or other
MATILTVASFFALVCISQQAXAANYTFMKDAVHAPRTGFYDYIIVGGGNGGLPAGGHPVGPPAXAAAEPRXSPYEDPAV

SEQ ID NO: 35644 - DNA, 739 bp, Zea mays
  misc_feature: Ceres CLONE 1415489-F
  misc_feature (251)..(251): n is a, c, t, g, unknown, or other
  misc_feature (277)..(277): n is a, c, t, g, unknown, or other
  misc_feature (278)..(278): n is a, c, t, g, unknown, or other
  misc_feature (474)..(474): n is a, c, t, g, unknown, or other
  misc_feature (483)..(483): n is a, c, t, g, unknown, or other
  misc_feature (510)..(510): n is a, c, t, g, unknown, or other
  misc_feature (511)..(511): n is a, c, t, g, unknown, or other
  misc_feature (515)..(515): n is a, c, t, g, unknown, or other
  misc_feature (516)..(516): n is a, c, t, g, unknown, or other
aaagctggagctccccgcggtggcggccgctctagaactagtggatcccccgggctgcaggaattcgcacgagaccattacctagaacatcctaatcgaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccancctgcgcgtcgcgccgcctggatccnngcggcacgtggctaggagcctcagatccgggcgaaacccagccttccgtgcggacgtcttcactctacctccagactggcggctgccatttccccccctcttcttgctgtttttttggtggggggtgggggggtggaaatctgcgggtggagtctttgccgtcgctcgctgtaaaacgtagagctctctctctctnctggcgagnaatccctggtcttgctcccatttccgnngtanngctggcggtgtgagtggcaaggtttaccgtgtaggatgtgggaacagttcctgagcagtttggccccgggaggtcgtcggccctccggggactcgggaaaattgaagaaggggcgccgaaataaaggggacgagcaggtgggaaaaaatcccggcgggcggcccccggcctcggccatttggggcaggcaatccgcctcttcccctcgagggggtggggtgga

SEQ ID NO: 35645 - DNA, 574 bp, Zea mays
  misc_feature: Ceres CLONE 1415492-F
  misc_feature: Encodes the peptide sequence at SEQ ID NO. 35646
  misc_feature (317)..(317): n is a, c, t, g, unknown, or other
tccccgcggtggcggccgctctagaactagtggatcccccgggctgcaggaattcgcacgagaccattacctagaacatcctaatcaaaaaacaaatcccacccaaaaaaaaaacgcctcccggttgctcgcctctatcctcattgaaaatctttgaaagaggtttggatcccgaaaccgccaagggcccgccccgcaagtgcatggcagtgaacttcctggccaatgaggtgtcggacctgtgcatcggcaagccggccgtgaggtcgctaccgctctccgccgccaccggcgaccttgccgccgccctccggagntgtcccgctctggcgccgcagctgcgtcgcggtgaccggacagcgcgcgccgtcgtcggccgggtcggcctcgcggacgtcctctggtttctctgcaccgaccccgaggggcccgcgcgccccggccgggttgtccgccaaggcgggtctccgcgctcctggcctaagggacaggggcccggaaaaggtcccccccgggtcaaacccccggttcaataatctttggagggccctttggaggggaatttctgaagggg

SEQ ID NO: 35646 - protein, 110 aa, Zea mays
  misc_feature: Ceres CLONE 1415492-F
  misc_feature (38)..(38): Xaa is any aa, unknown, or other
MAVNFLANEVSDLCIGKPAVRSLPLSAATGDLAAALRXCPALAPQLRRGDRTARAVVGRVGLADVLWFLCTDPEGPARPGRVVRQGGSPRSWPKGQGPGKGPPRVKPPVQ

SEQ ID NO: 35647 - DNA, 608 bp, Zea mays
  misc_feature: Ceres CLONE 1415493-F
  misc_feature: Encodes the peptide sequence at SEQ ID NO. 35648
  misc_feature (319)..(319): n is a, c, t, g, unknown, or other
aaagctggagctccccgcggtggcggccgctctagaactagtggatcccccgggctgcaggaattcgcacgagaccattacctagaacatcctaatcgaaaaaaagacgagatctacccgctgccccctcgcattcccctcccccgcgtcgtcatctccccaaatccccccaaaccctaccgccgatccggccccagatcgccatggccgcgcccaacagcaatgacgccgccagcgccagcggcaccggcccggctggcgaggaggacatctccatcgaagcgttggcgcggcgcgtgcaagagcaaatggaccctcnaattcgaacccggccgtcgccgcacaagtttggaaacacgcccgcgccagttcgggacgcgccgagatcgtaacgaggccccctgagccgccagccatttcgaggggggggggacccacccaatgccggcgctttaggggggtaccctggaaccccgaagaaaaaggggttctcccccgaaattttaatggtgtggttccccccaaaaaaaacctgcgggggggtggcgcaaaaaaaatggtgtgcgcggtgttaaaaaaaaatccccccggggggtttttcctttggg

SEQ ID NO: 35648 - protein, 62 aa, Zea mays
  misc_feature: Ceres CLONE 1415493-F
  misc_feature (39)..(39): Xaa is any aa, unknown, or other
MAAPNSNDAASASGTGPAGEEDISIEALARRVQEQMDPXIRTRPSPHKFGNTPAPVRDAPRS

SEQ ID NO: 35649 - DNA, 695 bp, Zea mays
  misc_feature: Ceres CLONE 1415496-F
  misc_feature (368)..(368): n is a, c, t, g, unknown, or other
aaagctggagctccccgcggtggcggccgctctagaactagtggatcccccgggctgcaggaattcgcacgagaccattacctagaacatcctaatcgaaaaaaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattggctggattcggcatcttacgggcttgaatagagctaggactggggagaaaacaacaaacccgcgttggatcctgtatcgatctgnagaaatttctaagtcgtcgtcgtcgtcgtcgttcggttcggagcggatctgaggcgacgatggctggaagcggccgaatctcttggtctgcagttctgcttcacctcgatgaatgatgtctctgcgctgataattattggatcaatttcgataattattagtagatctatgagatatgccgcctgggagaagccgagtaagctgcagcatgtaaaagtctgcgtgcgtccacagaaaaaagagaaaaaagatgtgacatctagaggaggctttgcatgaatggtgcgctccatggcagcccagtattaataaaagatgatattgtgg

SEQ ID NO: 35650 - DNA, 698 bp, Zea mays
  misc_feature: Ceres CLONE 1415497-F
  misc_feature: Encodes the peptide sequence at SEQ ID NO. 35651
  misc_feature (414)..(414): n is a, c, t, g, unknown, or other
  misc_feature (502)..(502): n is a, c, t, g, unknown, or other
  misc_feature (557)..(557): n is a, c, t, g, unknown, or other
atagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggncgaggcccccgcgtactggcaccgcgacaacttcgcgcggtacctgggacgtaaacccccggggggtttcgccgtccgcccgcgcttncggccggggaaggtcgggtacgccgcggtacgaccccgcgagcgcgccggtgggnaaggtggaaggcccttggacctcgggcacgggccaaggccgagcggaaacgcggcgagggtttccctgggggacccgccgtccggggggaaaaaaccccgagaaagttccctggcggaagggtgcccgggggcttggaagg

SEQ ID NO: 35651 - protein, 165 aa, Zea mays
  misc_feature: Ceres CLONE 1415497-F
  misc_feature (71)..(71): Xaa is any aa, unknown, or other
  misc_feature (100)..(100): Xaa is any aa, unknown, or other
  misc_feature (119)..(119): Xaa is any aa, unknown, or other
MAAVAEEEVIVVGAGQSGLAVAACLSLRGVRALVLERDDCVGSLWRKRAYDRLHLHLTKKYCALPHAPHPXEAPAYWHRDNFARYLGRKPPGGFAVRPRXRPGKVGYAAVRPRERAGGXGGRPLDLGHGPRPSGNAARVSLGDPPSGGKKPRESSLAEGCPGAWK

SEQ ID NO: 35652 - DNA, 704 bp, Zea mays
  misc_feature: Ceres CLONE 1415504-F
  misc_feature (299)..(299): n is a, c, t, g, unknown, or other
  misc_feature (308)..(308): n is a, c, t, g, unknown, or other
  misc_feature (579)..(579): n is a, c, t, g, unknown, or other
  misc_feature (599)..(599): n is a, c, t, g, unknown, or other
  misc_feature (600)..(600): n is a, c, t, g, unknown, or other
  misc_feature (611)..(611): n is a, c, t, g, unknown, or other
  misc_feature (632)..(632): n is a, c, t, g, unknown, or other
  misc_feature (676)..(676): n is a, c, t, g, unknown, or other
aaagctggagctccccgcggtggcggccgctctagaactagtggatcccccgggctgcaggaattcgcacgagaccattacctaagaacattcctaaatcgaaaaactagtcccaacttcccaaccaccgccagccgtccgttctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggntttggacgnaggagtgaaacgcgacggtgatcgtgcgaggtgggacgccatcagtgctctgtctggggttcggtctcttctttcgctgagatctggaagggtttcgtggtatccgtcgctacgatctgtcccagtcagagcacctggcatcatctcgggtcgggccatggagactctgctcatctcggaggagcgcaaccacagctccaccacttctcgggtcgccgggaagaaggcgtagcagcgtcgcctcagtcactcgcagctacatgcggcaaantggcgggcgttcactccggnnatcacgtcggnatcctgcgtcccgccccgggnaaagggttgaactgacccgctcctctctgagcccaagcaccgancatcagctccaccatgggaaaaagcgca

SEQ ID NO: 35653 - DNA, 637 bp, Zea mays
  misc_feature: Ceres CLONE 1415518-F
  misc_feature: Encodes the peptide sequence at SEQ ID NO. 35654
  misc_feature (255)..(255): n is a, c, t, g, unknown, or other
atagctggagctccccgcggtggcggccgctctagaactagtggatcccccgggctgcaggaattcgcacgagaccattacctagaacatcctaatcgaaaacactccgtaaaaccacaggaaacctcacacgtcttcctccgtccagcctgtctccggccggccccccgccttccttaactccgcatcatccccttccaatctcgtcttcccagcacccgaaccgatcaaattcacttccgctcgattctccgnggaggggggagggtagctgaaggacatcccggggacgcaatgcgcgtcctcgccgtgttcctcctcggcgcagcgttcgcggcggcgggcggaggcggcggggagcttccggagttccgggaagctccggcgttccgcaacggcgcaaccctgcgcggacgcgccgacgatccacatcgcgaagacggtggacgggacctacctgcggggactccctcgccgggggcctctccgtgctccgccaggccgactgaacaggagaccgacaacttcaaatttcgacagcattttcgggcctccacggggtgggcgactagacaatactcagacgggggagggggagacagacctatccacaaacaaaacatactccaaagacaat

SEQ ID NO: 35654 - protein, 114 aa, Zea mays
  misc_feature: Ceres CLONE 1415518-F
MRVLAVFLLGAAFAAAGGGGGELPEFREAPAFRNGATLRGRADDPHREDGGRDLPAGTPSPGASPCSARPTEQETDNFKFRQHFRASTGWATRQYSDGGGGDRPIHKQNILQRQ

SEQ ID NO: 35655 - DNA, 741 bp, Zea mays
  misc_feature: Ceres CLONE 1415526-F
  misc_feature: Translation starting site: 154
  misc_feature: SWISSPROT Homolog: EC 2.3.3.1 Citrate (Si)-synthase
  misc_feature (298)..(298): n is a, c, t, g, unknown, or other
  misc_feature (306)..(306): n is a, c, t, g, unknown, or other
aagctggagctccccgcggtggcggccgctctataactagtggatcccccgggctgcaggaattcgcacgagaccattacctagaacatcctaatcgaaaaattttgcttggctgctgctcccttctcccaccgaccaactcgatcccgcgccatggatcgcgccgaccccgcgcggggccgccttgccgtgctctcctcccacctccgtggtgcaggggtcgaggaggcgtcggtgctggagaggtcgccggtatccgcagcggcgcccgggtcccgcgacggagcgcttgccgtgntgaacggnaggaccggaaagcggcacgaggtcaaggtctccgaagagggcaccgtgcgcgccaccgacttcacgagattaccactggaacgacgacaagggtcttaagatttatgatcctggttactttaaacactgcccctgttcggtcgtccatctggtaaatcgatgaagaggaggaattccttcgttatagggtttatccaaccgaaacattgggtgaaagcacctccgtttgttgagggggccctacctttttatgggagggggaatttgcctacccaaaggtcaattgggcgggggggaattttgcaatttcccagaattttggaggcccccaagggacgggtgggaaataaaaaaaaaaaggggccccagggggccccccccaatggggggtttcttgccaaggaaaataaaccccctttttgtgtttctattaca

SEQ ID NO: 35656 - DNA, 711 bp, Zea mays
  misc_feature: Ceres CLONE 1415540-F
  misc_feature: Encodes the peptide sequence at SEQ ID NO. 35657
  misc_feature (257)..(257): n is a, c, t, g, unknown, or other
  misc_feature (297)..(297): n is a, c, t, g, unknown, or other
  misc_feature (304)..(304): n is a, c, t, g, unknown, or other
  misc_feature (411)..(411): n is a, c, t, g, unknown, or other
  misc_feature (439)..(439): n is a, c, t, g, unknown, or other
  misc_feature (497)..(497): n is a, c, t, g, unknown, or other
  misc_feature (500)..(500): n is a, c, t, g, unknown, or other
  misc_feature (550)..(550): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcaaaaatgcatcgggaacccttacacaggtagataccacaaccctgtgcagagttcttgcattctcgtcaaggtgacaggaacgacataggaaatggaggccaccctgtgcccaaagccccatttcgtggtcatcccatgggcagccaccagccacatgantcccatcgtggacatcggctgcctcctcgccgcgcacggngccgcgntcacgatcatcaccacgccctccagctcgcaactcgtccagagccgcgtggaccgcgccgggcaaggctcagcgggggtcacggtcaccgcgatcccgttcccgggngccgaagccggcctggccggacgctgcnagaagacggaccacatcccctccccctgactcgtgcccaacttcttcgtcgccaccgncgnttcggcgaagccgtggcgcggaactgccgccgcctgcccagggccacggnggggcacccccggccgagctgcgtcgtccccgggattgtgcccaccgtgggcgaacggggtggggagngaaattcggggccccctggttcatcttccacgggtttctggcgcgttccctctggtgggggtggaaaacctcaacacgcacagccggggaggg

SEQ ID NO: 35657 - protein, 92 aa, Zea mays
  misc_feature: Ceres CLONE 1415540-F
  misc_feature (23)..(23): Xaa is any aa, unknown, or other
  misc_feature (39)..(39): Xaa is any aa, unknown, or other
  misc_feature (84)..(84): Xaa is any aa, unknown, or other
MEATLCPKPHFVVIPWAATSHMXPIVDIGCLLAAHGAAXTIITTPSSSQLVQSRVDRAGQGSAGVTVTAIPFPGAEAGLAGRCXKTDHIPSP

SEQ ID NO: 35658 - DNA, 694 bp, Zea mays
  misc_feature: Ceres CLONE 1415547-F
  misc_feature: Translation starting site: 241
  misc_feature (202)..(202): n is a, c, t, g, unknown, or other
  misc_feature (471)..(471): n is a, c, t, g, unknown, or other
  misc_feature (579)..(579): n is a, c, t, g, unknown, or other
  misc_feature (643)..(643): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaactcatttttctctctcctgcgccgcgacgtccctcgccttcgccgccgaatccgagactccgatctcgggttcaccgcagcgcacagagcagccccgactnccgggcccgatcgcgctctcctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatgggcctcccagagatcttctgagaggcatttatgcttatggttttgagagccatctgcgattcagcagagaggaatttgtcccttctgcagggntcttcatgtcattcagcaagcacaatctgggacagggaagacagcacccttctgttctgggatcttgcaccacctgaactatggcctgggtgaatgccaggccctggntcttgctcccaccggtgagttgccagaaatccagaaagtctgcgcgcgcttggggataccttgnggtaaggccatgctggttgnggaggaccatctgccgggagacaaaggatct

SEQ ID NO: 35659 - DNA, 658 bp, Zea mays
  misc_feature: Ceres CLONE 1415550-F
  misc_feature: Encodes the peptide sequence at SEQ ID NO. 35660
aaagctggagctccccgcggtggcggccgctctagaactagtggatcccccgggctgcaggaattcgcacgagaccattacctagaacatcctaatcgaaaacacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaa

SEQ ID NO: 35660 - protein, 132 aa, Zea mays
  misc_feature: Ceres CLONE 1415550-F
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFE

SEQ ID NO: 35661 - DNA, 690 bp, Zea mays
  misc_feature: Ceres CLONE 1415551-F
  misc_feature: Encodes the peptide sequence at SEQ ID NO. 35662
  misc_feature (488)..(488): n is a, c, t, g, unknown, or other
  misc_feature (548)..(548): n is a, c, t, g, unknown, or other
  misc_feature (549)..(549): n is a, c, t, g, unknown, or other
  misc_feature (666)..(666): n is a, c, t, g, unknown, or other
  misc_feature (690)..(690): n is a, c, t, g, unknown, or other
aaagctggagctccccgcggtggcggccgctctagaactagtggatcccccgggctgcaggaattcgcacgagaccattacctagaacatcctaatccaaaagaaggggaggaatcccttcctccgcgagtcgcgagccgtggagatccgtcccactccacccctccgctccgccccagacctcgctacaaacctgccgcgaaaatagcagccgcccgtttgctctctcccgtctccgcactcctcccgcgatgagcgacccgcggggccgcgccgccggtcccgaccgctacggggacgaaccgcacgacctcccgctcgccgaggacgcaaacggcgaggaagcgtggcagacgcccgagaaagaggcggttgccgtgtcggaaggggccgctgcgcggagtggggatacgaccccggacgctgaacaggagagcgatgacggagaggaaggagtgggctccccggatcaggcggaacccaatggnagcgggggagggcgtaccgcccgtggccgcgactgtggagccggatgggattgttagcgnncgcaaggtggagacgaacagcgaggacgccatcagcattgacgccgacgaggagggaggaggacgacgacgatgactccacccaggatgcgtctcggatagccgaggtggaatgtgnagggcgaaaaagtgggcgccttcn

SEQ ID NO: 35662 - protein, 97 aa, Zea mays
  misc_feature: Ceres CLONE 1415551-F
MSDPRGRAAGPDRYGDEPHDLPLAEDANGEEAWQTPEKEAVAVSEGAAARSGDTTPDAEQESDDGEEGVGSPDQAEPNGSGGGRTARGRDCGAGWDC

SEQ ID NO: 35663 - DNA, 693 bp, Zea mays
  misc_feature: Ceres CLONE 1415559-F
  misc_feature: Encodes the peptide sequence at SEQ ID NO. 35664
  misc_feature (350)..(350): n is a, c, t, g, unknown, or other
  misc_feature (351)..(351): n is a, c, t, g, unknown, or other
  misc_feature (361)..(361): n is a, c, t, g, unknown, or other
  misc_feature (431)..(431): n is a, c, t, g, unknown, or other
  misc_feature (432)..(432): n is a, c, t, g, unknown, or other
  misc_feature (693)..(693): n is a, c, t, g, unknown, or other
tggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctggggactccccnntcctctccgnatccgcagccgcgacgccgagtggtacttcttcgcccgtctcgaccgcaaggtcgccggcgctggcgccnnggggccgggcggtcccggcaacaggaccaaccgcgctacgccgagggggtactgggagaacacgggcaaggaccgcgaggtgcaccaccgcggcaagcccgtcgggatgaaaagacgctcgtcttccacgcgggagggcgcctaagggcgagaggaccactgggtcatgcacgagtaccgcctctcgatgaagacggactcaggatctgcatgtggtttgaaaaatcttccagaacatgggtctggacaaagaacgtgggn

SEQ ID NO: 35664 - protein, 145 aa, Zea mays
  misc_feature: Ceres CLONE 1415559-F
  misc_feature (24)..(144): Pfam Name: NAM Pfam Description: No apical meristem (NAM) protein
  misc_feature (71)..(71): Xaa is any aa, unknown, or other
  misc_feature (98)..(98): Xaa is any aa, unknown, or other
MSLSPLDSSSPPAAAAAAATEVPLAPGFRFHPTDEELVSYYLRRRVLGRRLRVDAIAEIDLYRLEPWGLPXPLRIRSRDAEWYFFARLDRKVAGAGAXGPGGPGNRTNRATPRGYWENTGKDREVHHRGKPVGMKRRSSSTREGA

SEQ ID NO: 35665 - DNA, 825 bp, Zea mays
  misc_feature: Ceres CLONE 1415561-F
  misc_feature: Encodes the peptide sequence at SEQ ID NO. 35666
  misc_feature (1)..(1): n is a, c, t, g, unknown, or other
  misc_feature (16)..(16): n is a, c, t, g, unknown, or other
nggggccccccccccncccccccccccccccctcattttaggattgggtgcaaagctggagctccccgcggtggcggccgctctagaactagtggatcccccgggctgcaggaattcgcacgagaccattacctagaacatcctaatctaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcgggggggccgggggggttctttccgcgcggggcccgcgctacgggccggcttgcaaggcaacggccggacagtggacccttgaagaaatttcccatttggagaaagggtccaggttaaaattccctccagggaaatggttctggcaatatggttgggcggctggctttggtttggggcggcttaattcctggtttggcttacccattcttttggggggggggccaaagggccggcactttggaattattcttcggggtgagggaatccttggggaatttggctggaaaaaagggttggctttctgacaagctggacggggggaggggttaaggaacacattcctctggggctggggggggggaaacccatagggttccgctttttatccttggggagggcg

SEQ ID NO: 35666 - protein, 159 aa, Zea mays
  misc_feature: Ceres CLONE 1415561-F
MMRCAATGGGCVASWSGDWRLPAVNPCSVRMPTGNDGWCAGLRSRAADLAGLEMANLRGGAGGVLSARGPRYGPACKATAGQWTLEEISHLEKGSRLKFPPGKWFWQYGWAAGFGLGRLNSWFGLPILLGGGPKGRHFGIILRGEGILGEFGWKKGLAF

SEQ ID NO: 35667 - DNA, 619 bp, Zea mays
  misc_feature: Ceres CLONE 1415562-F
  misc_feature: Translation starting site: 220
  misc_feature (253)..(253): n is a, c, t, g, unknown, or other
  misc_feature (279)..(279): n is a, c, t, g, unknown, or other
  misc_feature (335)..(335): n is a, c, t, g, unknown, or other
  misc_feature (389)..(389): n is a, c, t, g, unknown, or other
  misc_feature (413)..(413): n is a, c, t, g, unknown, or other
  misc_feature (493)..(493): n is a, c, t, g, unknown, or other
  misc_feature (508)..(508): n is a, c, t, g, unknown, or other
  misc_feature (533)..(533): n is a, c, t, g, unknown, or other
  misc_feature (535)..(535): n is a, c, t, g, unknown, or other
  misc_feature (536)..(536): n is a, c, t, g, unknown, or other
tccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctgncggcggcgctggctgccatgtggtgncgtcggtgctccaagacggcggtgtcgacggcctccgccggggcctccgggttggncggtggtggggaaacctgtcccagtgatcctgagcgacggccttcatgtacgtntgcgcgacctccggagagtacggnccatcttcacatgcggatggggcacgcaccctcatcgtggtcactcggcggagctcatccacgagcgctggtgagcaggnccccatggtcgcgangcggcccgaagacagccccacccgncnntctctcagggtcgggaagtgcaccgtcaacttcgcgccctaacgccccctggtgggtgctctgcgccgcaactccgtcgccga

SEQ ID NO: 35668 - DNA, 652 bp, Zea mays
  misc_feature: Ceres CLONE 1415682-F
  misc_feature: Encodes the peptide sequence at SEQ ID NO. 35669
  misc_feature (344)..(344): n is a, c, t, g, unknown, or other
  misc_feature (652)..(652): n is a, c, t, g, unknown, or other
tccccgcggtggcggccgctctagaactagtggatcccccgggctgcaggaattcgcacgagaccattacctagaacatcctaatcgaaaaattaagactagctaactagcgtgaaagagctcctccgacgactactagctctcgcttgctccgacgacccctgccggccgcctctggtacaacgtacgagaggaagagagacgatcgatggccggcgccaccgtgaccgtggacgaggtgagggaaggccagcgcgcgaccgccccgcccacgtgctggccatcgggaacggcgacgcccgccaactgcgtgtaccaggccgactacccggactactacttcnggatcaccaagagcgaccacctcaccggacctcagggagaagttcaggaggatgtgcgacaagtcgatgatccggaagggtacatgcacctgacggaggagtttctgtccgagaacccgagaatgtgcgcgtacatgccgcccgccctggacccgcggaaggacgtggtgttgaccgaggtgccaaaacttgggaaaggcggcggccaaaaaggcgatccaagggggggggcaagcccaagtcgcgggatccccgcaccttggggttctgcacccccctccggggtgggaaatggccgggcccccaan

SEQ ID NO: 35669 - protein, 147 aa, Zea mays
  misc_feature: Ceres CLONE 1415682-F
  misc_feature (6)..(147): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (46)..(46): Xaa is any aa, unknown, or other
MAGATVTVDEVREGQRATAPPTCWPSGTATPANCVYQADYPDYYFXITKSDHLTGPQGEVQEDVRQVDDPEGYMHLTEEFLSENPRMCAYMPPALDPRKDVVLTEVPKLGKGGGQKGDPRGGASPSRGIPAPWGSAPPSGVGNGRAP

SEQ ID NO: 35670 - DNA, 675 bp, Zea mays
  misc_feature: Ceres CLONE 1415684-F
  misc_feature: Encodes the peptide sequence at SEQ ID NO. 35671
  misc_feature (616)..(616): n is a, c, t, g, unknown, or other
aagctggagctccccgcggtggcggccgctctagaactagtggatcccccgggctgcaggaattcgcacgagaccattacctagaacatcctaatcgaaaaggaatcctctcgagctcgtcgaaccttctggctcgccgccagcgcgctccattctccaactacctcaccaccctataaatgtagtcgcctactcgcctctgcgccgtcaccatcgcgaagacacactgggtaggaagatcgcagaaaaaggaagcagcagctttgatcgggtggagtttcttgctcactgatcgtcgagttcctgttcgattgaagttccaggcgcggacacgcactgaagcctttggggtccgtgacgatgtcgaggagagccgcagcgttgttgctcgcgtgcctcgtcgccgtgacagcggcggcgctggcggacggcgcgctgctcccgtggttcggcgacggccggcgcgggctcgacgaggcagcggtgtccgacgtgggcctcctggcgggcgacccgttcgggatcctggagcacgtcccgttcggcttcgaccgggacgacgtgggcatggtctccatgggcgcgcgtggactggggcgagacccccacgcgcacngagatccgtgctcaacgtgccggggatgcgcagggaggacctcccggatcgaggcgagg

SEQ ID NO: 35671 - protein, 105 aa, Zea mays
  misc_feature: Ceres CLONE 1415684-F
  misc_feature (86)..(86): Xaa is any aa, unknown, or other
MSRRAAALLLACLVAVTAAALADGALLPWFGDGRRGLDEAAVSDVGLLAGDPFGILEHVPFGFDRDDVGMVSMGARGLGRDPHAHXDPCSTCRGCAGRTSRIEAR

SEQ ID NO: 35672 - DNA, 786 bp, Zea mays
  misc_feature: Ceres CLONE 1415688-F
  misc_feature: Encodes the peptide sequence at SEQ ID NO. 35673
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (19)..(19): n is a, c, t, g, unknown, or other
  misc_feature (30)..(30): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnccccccccccccccnccccccttttntgaattttggggacnnnnntcaaagctggagctccccgcggtggcggccgctctagaactagtggatcccccgggctgcaggaattcgcacgagaccattacctagaacatcctaatcgaaaatatttcagtccattcccaccttcgtccaatcgtccccgtcaacaccggcgcttccttccttcctccctccgtacatccctctctctctccctctctcctgccctcttcgcctcttctgcccagccatccctgacgacgcgaggcggcaaataacctctccggggacgaggccgatggagtcgacttccggcgaagacgctccgaagcgcaacccgctcccgtccgcgctcgtctccaacctcgagtctgtgcttgccgcccgccgcccggccgcggccgaggtcagcaccgccgccgcagccggcgagggctgaagcctcggctcccgaggatgccccctctggagatggggcgccggcgaggcccatcgtgctgctgacctgtgccgggggggatccggtgccgcggggtcttggcggcgctccgtcaacgccctcgttaccgggcgcccggctgcgacgtcccacgggggggtgctcccggaaatcggaaaaaggccaggcctggggggttactccaaataaccattccggggaaaaaccattcactgggggaaatttgcggtgggatttttccacagggtggcctaaaagagctttttggaagataataagcggcccacgcgccggggtt

SEQ ID NO: 35673 - protein, 46 aa, Zea mays
  misc_feature: Ceres CLONE 1415688-F
MESTSGEDAPKRNPLPSALVSNLESVLAARRPAAAEVSTAAAAGEG

SEQ ID NO: 35674 - DNA, 694 bp, Zea mays
  misc_feature: Ceres CLONE 1415697-F
  misc_feature: Encodes the peptide sequence at SEQ ID NO. 35675
  misc_feature (386)..(386): n is a, c, t, g, unknown, or other
  misc_feature (537)..(537): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttcccagtgatcctgcagcgancgcccttcatgtacgtggtgcgcgacctccgggagaagtacgggcccatcttcaccatgcggatggggcagcgcaccctcatcgtggtcacctcggcggagctcatccacgaggcgctgggtgaagcagggccccatggtcgcgagccggncccgagacagccccacccgctccctctcagggtcggaagtgcaccgtcactcggcgctacggccccccgtgtgggtgctctgcgcgcacttcctcgnccgagatcgtgcccgcacgcgtcagcttctctggggtacccggggagggggccggggacc

SEQ ID NO: 35675 - protein, 155 aa, Zea mays
  misc_feature: Ceres CLONE 1415697-F
  misc_feature: SWISSPROT Homolog: EC 1.14.13.11 Trans-cinnamate 4-monooxygenase
  misc_feature (53)..(53): Xaa is any aa, unknown, or other
  misc_feature (103)..(103): Xaa is any aa, unknown, or other
MDVNDVLLVVLAAALAAMWWRRCSKTGGVDGLPPGPPGWPVVGNLFPVILQRXPFMYVVRDLREKYGPIFTMRMGQRTLIVVTSAELIHEALGEAGPHGREPXPRQPHPLPLRVGSAPSLGATAPRVGALRALPRPRSCPHASASLGYPGRGPGT

SEQ ID NO: 35676 - DNA, 650 bp, Zea mays
  misc_feature: Ceres CLONE 1415707-F
  misc_feature: Encodes the peptide sequence at SEQ ID NO. 35677
tggagctccccgcggtggcggccgctctagaactagtggatcccccgggctgcaggaattcgcacgagaccattacctagaacatcctaatcgaaaaaactcgccgtctcgccagtcgccaccatctaaagccgcggctccaatcccaccgcaggacaggcaggcagagcgcgccccgcgccatttcagccatgtcgacgacgtcgtcgtcgtcgtcgtcgtcgtcgtcgtcgtcgttccagtggcgcccatgggtggcactctcctccatccccgtcgtcgtcggcgccaacaacgagcgggcacggaggctcgcgcccggtgcctccgacctctttctcgacatccagctcccacagcacggcgcctcctacctgttcctgcccgagcgcatcataccggagcccaggaattcgtattcaggccgccaccccttcaccatcctgtccgcctgctccgaccgcttcctcttcattggcggttgggggtacccgaagccgagggcgtctcgaaccccgcctgcttcctcggcaacgcccaggccagcaccgccgtcggccctccccgacgtcccgccccacctcggcgtcaacatcatactgcgaaacagcattggcctcatcgccgaccggcgacacggtggccattta

SEQ ID NO: 35677 - protein, 153 aa, Zea mays
  misc_feature: Ceres CLONE 1415707-F
MSTTSSSSSSSSSSSFQWRPWVALSSIPVVVGANNERARRLAPGASDLFLDIQLPQHGASYLFLPERIIPEPRNSYSGRHPFTILSACSDRFLFIGGWGYPKPRASRTPPASSATPRPAPPSALPDVPPHLGVNIILRNSIGLIADRRHGGHL

SEQ ID NO: 35678 - DNA, 837 bp, Zea mays
  misc_feature: Ceres CLONE 1415710-F
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (640)..(640): n is a, c, t, g, unknown, or other
  misc_feature (642)..(642): n is a, c, t, g, unknown, or other
tttttttgggnnnnnnnnnnnnnnnccaccccggggaagaggaaggcacctttccccccaaagctgaagctccccgcggtggcggccgctctataactagtggatcccccgggctgcaggaattcgcacgagaccattacctagaacatcctaatcaaaaattttccaaatccgtctacgccctcacgcacgcggcccaactagcctaacaaaccctagctagatttagaaaaaaagtttgtccccaatccgaatcgacgaggagctcgccgccgtgagatgtcccgagtacgacgagcgctaccagggcaacgccgacatgcccgcagccgaaggcgggtattccgaagccgagtaaggcgccgccgccgcggcctgccggcgggggggttccccgccccccaaacaagaaaggccctccgggtttccccgaacaacgccgaagggccggttcctccccgggccccggcgtggggaaacccatcccccctggaaggtggggttcccccgaaaaactccccagaaaaggggcccccgaaaaaacccggataaagggggccaaggggaaaggggagacgggggaaaaaagggaaactcttgggggccccaaaaaaaaaggcggcggggggccccccgaaananggggggaaaaaaggagattccgcgataaaaaaaaaggggccaaaaaaaaaaaaaaaaaaatcggggggcgcgccccccccccccgggggggcaccccccacaaaagggggccgcggggaaaaaaagggggggaaccacccccggggggaacctccttccggagaggatcctgggagcagcgcgtcccccccgcgg

SEQ ID NO: 35679 - DNA, 674 bp, Zea mays
  misc_feature: Ceres CLONE 1415712-F
  misc_feature: Encodes the peptide sequence at SEQ ID NO. 35680
  misc_feature (554)..(554): n is a, c, t, g, unknown, or other
  misc_feature (561)..(561): n is a, c, t, g, unknown, or other
  misc_feature (562)..(562): n is a, c, t, g, unknown, or other
aagctggagctcaccgcggtggcggccgctctagaactagtggatcccccgggctgcaggaattcgcacgagaccattacctagaacatcctaatcgaaaagtcgagttaacaaagtcacctcatccaatcttgcatccccatctctgtctttgctcctccatggccatggccatggcccgaccttgtgctttccttctcttcttcctagttcttttctcctacgacggatccggtcctgggagcagcagcaggaggagtggcgtcgctcaggccacgcagagagtcttcctgtatccacaggctcccaaggtctcctccatcgtgagcagcaagtacaggaccgcgtaccacttccagcctcccaagaactggatcaacgatccaaatggaccaatgtactacaatggtatctaccaccagttctaccagtacaacccaaacggctcgctctggggcaacatagtctgggcgcactcggtctccacagatctcgtgaactggatccggctcgcgccggcgatagagcggacgactccgagcgacatcaatggnctgctgnnacaggtcagccaccatcctcaagaagcggccggcctggcatcatatacaccggcgccgacacccgagaaacgtcaggtccaaaaactgggcgtccccaggaaactgtcaatc

SEQ ID NO: 35680 - protein, 171 aa, Zea mays
  misc_feature: Ceres CLONE 1415712-F
  misc_feature (64)..(171): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (134)..(134): Xaa is any aa, unknown, or other
MAMAMARPCAFLLFFLVLFSYDGSGPGSSSRRSGVAQATQRVFLYPQAPKVSSIVSSKYRTAYHFQPPKNWINDPNGPMYYNGIYHQFYQYNPNGSLWGNIVWAHSVSTDLVNWIRLAPAIERTTPSDINGLLXQVSHHPQEAAGLASYTPAPTPEKRQVQKLGVPRKLSI

SEQ ID NO: 35681 - DNA, 699 bp, Zea mays
  misc_feature: Ceres CLONE 1415730-F
  misc_feature: Encodes the peptide sequence at SEQ ID NO. 35682
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaccccgtccctccactcctcccgtcgagcacttggcactgccaatggcggcagccgcccacaccccttcgatgcgtgcaagccgcctcctttcctcctgagatcgacgcacctcctcctctcgtactccattcccgctccaagtttgtttcttcggcaccgagccatcgcacggccgcccccgcatctcgtcctgctctcaggtccttggcctccgccgttcttcgacaggggcgcgacccggtgcccactccgcgaaatccgagtccctcgtgcagctccgtagggtggaagagatccatcaggcggtgagcggtaggaggcgcccgtacaactgagggggcgggcaatggcggccgtggcaggcccactctgcacgtggctcgttgccgcgtgctggtctgcggcttgcgacgcagaagagtacaagcataagcattgctgccccggcgaaagcggcgctgggggggggtcatgctcggccagcgccgcccgctccgngaggcgggtcgcggtttgggcgctctgaaatggtatggctgttgcctacagctgaaagaggctgattgaaagaaaaacccgattcaacaaagggggtg

SEQ ID NO: 35682 - protein, 59 aa, Zea mays
  misc_feature: Ceres CLONE 1415730-F
  misc_feature (51)..(51): Xaa is any aa, unknown, or other
MAAVAGPLCTWLVAACWSAACDAEEYKHKHCCPGESGAGGGSCSASAARSXRRVAVWAL

SEQ ID NO: 35683 - DNA, 701 bp, Zea mays
  misc_feature: Ceres CLONE 1415735-F
  misc_feature: Translation starting site: 206
  misc_feature: SWISSPROT Homolog: EC 2.5.1.47 Cysteine synthase
  misc_feature: SWISSPROT Homolog: EC 4.2.1.22 Cystathionine beta-synthase
  misc_feature (439)..(439): n is a, c, t, g, unknown, or other
  misc_feature (474)..(474): n is a, c, t, g, unknown, or other
  misc_feature (477)..(477): n is a, c, t, g, unknown, or other
  misc_feature (646)..(646): n is a, c, t, g, unknown, or other
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcaaaaatcatctccagcggcttcttccaaagctccaactacgacgagaaccgccactcctcgaaatctccaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcacggacgcagaggagaaaggctgattactcccagcgtgagtggtctgattgaacaactagcgncaacacaggcattggactggcctttatggctgctngcnagggctacaaacttacactcacaatgcctggctccatgagcatggagagggagatcatattgaaggcttttggtgctgaacttgtcttactgacccactcctgggaaatgaaaggagctgtcagaaagcggaagagatacagcaaagacaccccactcgtacatccttnncacatttgaaaatccggctaaccccaagattcactatgagactactggggctga

SEQ ID NO: 35684 - DNA, 790 bp, Zea mays
  misc_feature: Ceres CLONE 1415737-F
  misc_feature (1)..(1): n is a, c, t, g, unknown, or other
  misc_feature (15)..(15): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (36)..(36): n is a, c, t, g, unknown, or other
  misc_feature (52)..(52): n is a, c, t, g, unknown, or other
  misc_feature (53)..(53): n is a, c, t, g, unknown, or other
  misc_feature (57)..(57): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
nggggttgggggganacccccccaccacnnncananccacgggggggggggnntttntttnnntcaaagctggggctccccgcggtggcggccgctctagaactagtggatcccccgggctgcaggaattcgcacgagaccattacctagaacatcctaatcgaaaaaccaccaagtggacgcagcagctttaaccccccaaagcctcgacgccgcgagcacagctccgccgccaccgcccccttctcatccgcggtctccgccgcctgctgcatctctatcgatctagcgggactggctccttcccgtgctgggtccttcgtcaatcgtcagcgcgcaagatcggcacttgtgtacatctgagcagtttccggggccctaaatttcaggggcggggcgttgttgggttttccaataatttttggggggttcaccctggaacccttcatgaaccccaggtggaaaccccgcccccttgggggggaaaagggatgcttgaaccggggcttggggggtggggcccccccccccggttcgggaagaaacccccgaaaagcggccggggctgggggaagaaaaaacccggcccggaaatggggggtttctgtgggggggggggcccccggaaaggaaggggggggcgttttctccgcgagacaaaagcggggttttgaaaaaaccacccgccccccgggggggcgtggggggacgcccctctgggggcgctagagaggtgggggagaccgccgcaaatacaaaagagggggccgcgcggaaaagagtgcgcgac

SEQ ID NO: 35685 - DNA, 693 bp, Zea mays
  misc_feature: Ceres CLONE 1415740-F
aaagtggagctccccgcggtggcggccgctctagaactagtggatcccccgggctgcaggaattcgcacgagaccattacctagaacatcctaatcgaaaaaatgtctacttgtctaccgtcgctgcgctagccctcctccctgcttcttgcttttgcctgagtctgcagcctgctgcaagcttttgctttggtttaggtgcttcttttccacccctttactgttccccccacttttgcttgctttgtcacgcacacgaaaagctcctgcctttaccttatctccgcacccgtagtggcatttggtgggagctgcgctgctcgcccctcgcgtttctttgctcaattgggggtcacggtcacggcccgcgagtgctgcgacgtgctcgtgtgcggcaggaattaccggctcctagcgacgaccgtcccactcggcgattgcgaacactctcatgcacatcttctcgccattcccgcaatttcgccccaccatgaactgctaaaacgactaaccagctgccgccggggacggcgccatcatgcttcctcaacctgacctggcaccagtctatggccgccgaccacttcgacccggcgctcacctcgatggcctcctccccggcgttcacctagacggtcgcccccgcgcctactgaagcgccgctatccccccgtcatcccttcagcaccataa

SEQ ID NO: 35686 - DNA, 642 bp, Zea mays
  misc_feature: Ceres CLONE 1415743-F
  misc_feature: Encodes the peptide sequence at SEQ ID NO. 35687
  misc_feature (176)..(176): n is a, c, t, g, unknown, or other
aaagctggagctccccgcggtggcggccgctctagaactagtggatcccccgggctgcaggaattcgcacgagaccattacctagaacatcctaatcgaaaacatagagatagagatagacagctagcttcatcagtaggatgggcagcgacgaggaagcggcgctgcttggtgcncggcggtggaggagggttgccccgggtgcgtgatggagcggcggaaggcgagcagcaacggcaggatcccctacagggagctgttcttcgtcgccgccacctccctcgcctcagctttaccgatcacgtgcctcttccccttcttgtatttcatggtaagggacttccgcgtcgctgaaacagaggaagacatcggattctatgctggtttttcttgctgcgtcgtacatggtgggcagaggctttctctccatctttctgggcgtcatcgcagaccgcgttggacggagcctggcatcacgtttcgatactggccgggggcgaatccagggggtttgttggctgaaccccacctacgggatggggatccccccaaggttcgggttgggggttccaaaggccggttcccccaaaaaaagggaccggggtttaaatttgccaaaacccacacccggggttgggtttt

SEQ ID NO: 35687 - protein, 144 aa, Zea mays
  misc_feature: Ceres CLONE 1415743-F
MERRKASSNGRIPYRELFFVAATSLASALPITCLFPFLYFMVRDFRVAETEEDIGFYAGFSCCVVHGGQRLSLHLSGRHRRPRWTEPGITFRYWPGANPGGLLAEPHLRDGDPPKVRVGGSKGRFPQKKGPGFKFAKTHTRGWV

SEQ ID NO: 35688 - DNA, 682 bp, Zea mays
  misc_feature: Ceres CLONE 1415750-F
  misc_feature: Encodes the peptide sequence at SEQ ID NO. 35689
  misc_feature (419)..(419): n is a, c, t, g, unknown, or other
  misc_feature (420)..(420): n is a, c, t, g, unknown, or other
  misc_feature (431)..(431): n is a, c, t, g, unknown, or other
  misc_feature (451)..(451): n is a, c, t, g, unknown, or other
  misc_feature (452)..(452): n is a, c, t, g, unknown, or other
  misc_feature (473)..(473): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaagctctactcctctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgctgggctgtgcggtccgctgtccgggctcctcgtcagnnccctcgtcggncacctctccgaccgcatggnnccgccgcttcgccgtcggggncgccgcaggccctcaatcgccgcggggggccgcgtggatccgccgcagccgtgggtcaccggtcggcttctccgctgacctcgggcgactctccgggggacgacgtcaacccggggctcaacgcgcctcggggccatctgcgnctaacctggtaaggatctggttgctcgacggtggcaacaacggcacgagggggccctggagggcgg

SEQ ID NO: 35689 - protein, 115 aa, Zea mays
  misc_feature: Ceres CLONE 1415750-F
  misc_feature (72)..(72): Xaa is any aa, unknown, or other
  misc_feature (73)..(73): Xaa is any aa, unknown, or other
  misc_feature (83)..(83): Xaa is any aa, unknown, or other
MPPRTAPAATSTPPRKVPLRKLLRAASVACGVQFGWALQLSLLTPYVQELGIPHAFASLAGLCGPLSGLLVXXLVGHLSDRMXPPLRRRGRRRPSIAAGGRVDPPQPWVTGRLLR

SEQ ID NO: 35690 - DNA, 663 bp, Zea mays
  misc_feature: Ceres CLONE 1415751-F
  misc_feature (444)..(444): n is a, c, t, g, unknown, or other
  misc_feature (587)..(587): n is a, c, t, g, unknown, or other
  misc_feature (598)..(598): n is a, c, t, g, unknown, or other
  misc_feature (628)..(628): n is a, c, t, g, unknown, or other
tggagctccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccaggcggtggtgcacgggaggaggaagcagcatccccaggccgccttcccgcccttcacctgcggcgcggccagcagcagtagagctcaagaaaaccagccgggtactaccgacccggtctcgctgttcaagacgggaggcctcttcgccgacttctcgtccggnctagacgccgcccgtggcaacggtgaccttgacgacaccgtgccctggatccactgccccatcgtcgaagagacagcgccgcacccgcacctgccctcgcggaggctacagcccagatttcttctcggagctccatgcagcgncgttagcagcnggcgcggcagagacgaacctcagctcttgncaacacgggtcagcacaagaaggcaccccggtgca

SEQ ID NO: 35691 - DNA, 709 bp, Zea mays
  misc_feature: Ceres CLONE 1415754-F
  misc_feature: Translation starting site: 259
  misc_feature (375)..(375): n is a, c, t, g, unknown, or other
  misc_feature (396)..(396): n is a, c, t, g, unknown, or other
  misc_feature (600)..(600): n is a, c, t, g, unknown, or other
  misc_feature (626)..(626): n is a, c, t, g, unknown, or other
aagctggagctccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggaggcttaggagcttctgcttcttttatggctgaaacatctttgctttatttgggattgtggggagagtactctcgtgcaactaggaaaagggcacagggtccgtcccactgcatgcgtcaagagactgtctggttttcttgntctgatttggcatttgctggngctcaaagccggcttggtttcctcgaaggatcagcatctactctttgattgtgggacttgtcgcatctgatatcaacttcataaatctttatccaagatggcgctgcaaaacattggtgcttcaaaaagggatgatgccttctacagggtacagatgcccagaatgattaccagatagaagggcggtgtaatggtatcaagacnaatggtggtgacaatgtttgaataanaaaagcactgggcagggcagcttcctacacaaccaagtattttgggagggggagcttgcggcacattccaaatttgatgagaa

SEQ ID NO: 35692 - DNA, 709 bp, Zea mays
  misc_feature: Ceres CLONE 1415760-F
  misc_feature: Encodes the peptide sequence at SEQ ID NO. 35693
  misc_feature (704)..(704): n is a, c, t, g, unknown, or other
aaagctggagctccccgcggtggcggccgctctagaactagtggatcccccgggctgcaggaattcgcacgagaccattacctagaacatcctaatcgaaaagcgattttaccgtggacgactggagagggcgacggggacgaacgagacgaccgtacattcgttatcggactgggaagcagcggcggtacaaagtgtgggagagaaaggagaagagacttgatgtcctcgcagtttgtccaatagatctcctcgccgcctcacccgtctcctcctccgcagcttccccgcgatcccgaccatggagggcgacggtaccaaccttgatgcggcgatagagtcgctcctgaatgtcgagaagcagatgaggctggccggagatgtcgccggcactcggaaggccgtcatcgacatcgtcgagctctgctacaaggccggcgcgtggaagacgctaaacgaccagatcgttctcctatctaagaggagaggccagcttaagcaggctattactgctatggttcagaaagcaatggagtatattaatttgacaccaggcattgacacaagcatcgagctaataaaaacactgagcagtgtctctgctggcaaaatctatgttgagatagagagagcaagattgatcaaaaggcttgcaaaaattaaagaggagcagggacagatttacgaggctgctgatttgatgncagaa

SEQ ID NO: 35693 - protein, 136 aa, Zea mays
  misc_feature: Ceres CLONE 1415760-F
  misc_feature (135)..(135): Xaa is any aa, unknown, or other
MEGDGTNLDAAIESLLNVEKQMRLAGDVAGTRKAVIDIVELCYKAGAWKTLNDQIVLLSKRRGQLKQAITAMVQKAMEYINLTPGIDTSIELIKTLSSVSAGKIYVEIERARLIKRLAKIKEEQGQIYEAADLMXE

SEQ ID NO: 35694 - DNA, 671 bp, Zea mays
  misc_feature: Ceres CLONE 1415761-F
  misc_feature (252)..(252): n is a, c, t, g, unknown, or other
  misc_feature (257)..(257): n is a, c, t, g, unknown, or other
  misc_feature (373)..(373): n is a, c, t, g, unknown, or other
  misc_feature (386)..(386): n is a, c, t, g, unknown, or other
  misc_feature (479)..(479): n is a, c, t, g, unknown, or other
  misc_feature (499)..(499): n is a, c, t, g, unknown, or other
  misc_feature (500)..(500): n is a, c, t, g, unknown, or other
aagctggagctccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctggccgccacgacctcgccggccacactcgcaggtcgccctcgctcctaacggctcgcggngaggncttctgccttttcgcgccctctatctgctgcgatctttggagcatcgttctcttctctcacttgagatccagacccctaaaccctaagagctcgcgcttccgctcgctcgctccgnggtgggggggacnatggaggacgaggagatggaaaaaaagtgcaccagtacttgcagcgcaaagggtttccgcctcactgagcttgcgctccaggaggagtgcaancgcctctccacctcggcatnntcgacgttgcgcttgccacgtctgacaatgatccagcgagatactacgatggatatagcagataaggaactggggatacagttctcttgatcatataggcacgaatacttcggcgtctttatcagttttcatcataactcatgatctaggggaaaaggactatgcgggagt

SEQ ID NO: 35695 - DNA, 507 bp, Zea mays
  misc_feature: Ceres CLONE 1415762-F
  misc_feature: Encodes the peptide sequence at SEQ ID NO. 35696
  misc_feature (239)..(239): n is a, c, t, g, unknown, or other
aaagctggagctccccgcggtggcggccgctctagaactagtggatcccccgggctgcaggaattcgcacgaaccattacctagaacatcctaatcgaaaaaatcagtggctcgctagcccaccacgctcctggaacctagcccggacaccagccagaacaggccatgtccatgggctccccggtgcagctcaggcggctgaagcctctgtaccagtttcgtggtgaacacatcctggncatcggtgggcgtgccgctcgcccaccgcggtcctgctcaaggcgtcgtcgctcgggccccgaggagaatctgggggttccgggccgggggaacttggttcctggccgggtttcctggcttgccgggggcacacggggctgtaaacctgaatggtcccccgcccccgccaagggggaacccgggggggaaataacggggggggtttccgccaccaaaccccccaaaatgtggggcggggtccccttttttggaaatatttctctgggg

SEQ ID NO: 35696 - protein, 114 aa, Zea mays
  misc_feature: Ceres CLONE 1415762-F
  misc_feature (25)..(25): Xaa is any aa, unknown, or other
MSMGSPVQLRRLKPLYQFRGEHILXIGGRAARPPRSCSRRRRSGPEENLGVPGRGNLVPGRVSWLAGGTRGCKPEWSPAPAKGEPGGEITGGVSATKPPKMWGGVPFFGNISLG

SEQ ID NO: 35697 - DNA, 679 bp, Zea mays
  misc_feature: Ceres CLONE 1415763-F
  misc_feature (190)..(190): n is a, c, t, g, unknown, or other
  misc_feature (242)..(242): n is a, c, t, g, unknown, or other
  misc_feature (309)..(309): n is a, c, t, g, unknown, or other
  misc_feature (310)..(310): n is a, c, t, g, unknown, or other
  misc_feature (313)..(313): n is a, c, t, g, unknown, or other
  misc_feature (314)..(314): n is a, c, t, g, unknown, or other
  misc_feature (580)..(580): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccnacatcgcccgggaggggagcagcagaagaagctccccttacctccgctatcngctgaggataagtggggtctgtagggagtcttaggggggagcaagggataggatagggagagagaannatnnatttctcgtccgcttcggccttggtacgtccgggtacaaacctaggacattcgccttttcccgtctaacccacctttctcgttaggccctacttggagggtgaaccctcaaagttcccacaaaatagggaaaaaaaacttttccgataattgggggaaaaaaatccgggcgggttttcttcggacaaaatgtccaaaaaaagagttttttgtgtttggtaaaaattaatatcccgaaaagggggccccccccccccttgggggggntttttccccccccttttcaaaagaaggggggggaccccnnnnnnnnnnnnnnnnnnnnnnnnnnnnnnnnnnnnnnnnnnnnnnnnnnnnnnnnnnnng

SEQ ID NO: 35698 - DNA, 710 bp, Zea mays
  misc_feature: Ceres CLONE 1415764-F
  misc_feature: Encodes the peptide sequence at SEQ ID NO. 35699
  misc_feature (453)..(453): n is a, c, t, g, unknown, or other
  misc_feature (494)..(494): n is a, c, t, g, unknown, or other
  misc_feature (497)..(497): n is a, c, t, g, unknown, or other
  misc_feature (503)..(503): n is a, c, t, g, unknown, or other
  misc_feature (600)..(600): n is a, c, t, g, unknown, or other
aagctggagctccccgcggtggcggccgctctagaactagtggatcccccgggctgcaggaattcgcacgagaccattacctagaacatcctaatcgaaaagttcccctttccctcctgcgcaccccgtcttctcctccccgcgtcaaaccccagcacaaaaagcaaccgcccgccgcctcctcgctcctctcccgaatcagccgtcgcggtgcctaatccggccgaccccccctccgatccgcgggtgcccgccgcagaggcggcgcctccgggcctccccgatgtatagcaaacttcaggagcaggcgatcgagtacgtcaagcaggcagtccaggaggacaatggccgcaactacgtcagggcgttccctctctacatgagcgcgctcgagtacttcaaaacccaccctcagtacgagaaagaccccaagatcgaggaggccatcaccgncaagttcaccgagtacctccgccgcgccgaagagatccggncgntcctcnatgagggcggcgcaggggctggggccaacggtggccacccaattgtccccaccccccccaaacccaaggcaaggatggggaacgaagcaacggaggnaataactccaataagtccaggtggggggggggttaacttccgcctattcccgaggagccacaatttaggggaaccactttgcggcctcaaaagggccaaggagcggttgg

SEQ ID NO: 35699 - protein, 142 aa, Zea mays
  misc_feature: Ceres CLONE 1415764-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (57)..(57): Xaa is any aa, unknown, or other
  misc_feature (71)..(71): Xaa is any aa, unknown, or other
  misc_feature (72)..(72): Xaa is any aa, unknown, or other
  misc_feature (74)..(74): Xaa is any aa, unknown, or other
  misc_feature (106)..(106): Xaa is any aa, unknown, or other
MYSKLQEQAIEYVKQAVQEDNGRNYVRAFPLYMSALEYFKTHPQYEKDPKIEEAITXKFTEYLRRAEEIRXXLXEGGAGAGANGGHPIVPTPPKPKARMGNEATEXITPISPGGGGVNFRLFPRSHNLGEPLCGLKRAKERL

SEQ ID NO: 35700 - DNA, 705 bp, Zea mays
  misc_feature: Ceres CLONE 1415859-F
  misc_feature: Encodes the peptide sequence at SEQ ID NO. 35701
  misc_feature (589)..(589): n is a, c, t, g, unknown, or other
aaagctggagctccccgcggtggcggccgctctagaactagtggatcccccgggctgcaggaattcgcacgagaccattacctagaacatcctaatcgaaaaataactactctgccaccaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggtatgcggcctggtgtatcattgaggccaggtactccagtggaggaaaaggaggcccagaccaccgacggggaaaaaacatcacgaacaccgttctccatagggggnagtagtgaggaaggaaagagagggggcggcctagggcttcgattccgcagccatggacgccgctgacgtgtggggccgctcgtcgtcctcgtcttcttcgtccgccgccgccgcgt

SEQ ID NO: 35701 - protein, 166 aa, Zea mays
  misc_feature: Ceres CLONE 1415859-F
  misc_feature (5)..(147): Pfam Name: Ribul_P_3_epim Pfam Description: Ribulose-phosphate 3 epimerase family
  misc_feature: SWISSPROT Homolog: EC 5.1.3.1 Ribulose-phosphate 3-epimerase
MAAAKIAPSMLSSDFANLASEAERMVRLGADWLHMDIMDGHFVPNLTIGAPVIQSLRKHTKAYLDCHLMVTKPSDYVEPFGKAGASGFTFHIEVARDNWQDLIQSIKSKGMRPGVSLRPGTPVEEKEAQTTDGEKTSRTPFSIGGSSEEGKRGGGLGLRFRSHGRR

SEQ ID NO: 35702 - DNA, 691 bp, Zea mays
  misc_feature: Ceres CLONE 1415860-F
  misc_feature: Encodes the peptide sequence at SEQ ID NO. 35703
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (32)..(32): n is a, c, t, g, unknown, or other
  misc_feature (42)..(42): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
nggggnnnnnnnnnnnnnnngggggaaaaaanggggaagaanggggaaaaggaannnncccccttnnncatagctggagctccccgcggtggcggccgctctagaactagtggatcccccgggctgcaggaattcgcacgagaccattacctagaacatcctaatcaaaaatccagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttcaaccaggggctcaacccctacgtctacatcacctaccgccatctgctcgtcgccgtcctcatctggcccttcgcatactacctggagaaggggctgaggcctaaaatgacgctcatgctgttcgttgagatattcgtgctctcccttctcggggtgagcttaactctgaacatgtacttcgcgagcctgaagtacacgtccccaacgttcgtcacttccgtggtgaacaccatcgcctcgatgacgttcgtcatcgccatcatcctcaggggacaaaaggccgga

SEQ ID NO: 35703 - protein, 140 aa, Zea mays
  misc_feature: Ceres CLONE 1415860-F
MAEREVVEGGTTTGGGLWRRYAPHVQMVLAQLCYTLMYFITEAAFNQGLNPYVYITYRHLLVAVLIWPFAYYLEKGLRPKMTLMLFVEIFVLSLLGVSLTLNMYFASLKYTSPTFVTSVVNTIASMTFVIAIILRGQKAG

SEQ ID NO: 35704 - DNA, 841 bp, Zea mays
  misc_feature: Ceres CLONE 1415874-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (55)..(55): n is a, c, t, g, unknown, or other
nnnncccccccccccccccccccnnnaactnntannnannannaccagacccttntcaaagctgggactccccgcggtggcggccgctctagaatagtggatcccccgggctgcaggaattcgcacgagaccattacctagaacatcctaatcaaaacagttctttctcgcttttcctcctctctgctttctcgcttttcctcctctctgcctttctttgctaccgtcggcgtcaggcgtcaggaactccgcttccacacgaatatttcgtctattgtcagcttgctcagcggctccgtttggtttggtgagatgtgtttccccctttatcctttcgtcgtgcggttccattccgtggataatcttttttcaataatccctttggggattagaatcaagcttcctctaaaccaagatccctccttggcttttttcccaaatgaaaaattgggaacccaaaaagggaaagtaatttttccttttgatagcttttgggcatggggcagaaataataaagggaagtggctttctacccccatttgaaaatcctatttttttggaaaaattgaaaaattgaaaaaagggaattttaattttccttttttttgaaaaagcccttttcccaaatgggggaaacttcttggggttcccaatttccaaatcatattggggtttttggggccaaacacctccgtgtggttttgggcaaaatttttaaaatcctggcaagaaaaaaggggttttttttatttcccatttggaaacttcacaaaagaggggaggggggaaatagggcccggggttggacacctttattggagactctccttaaaaactaatt

SEQ ID NO: 35705 - DNA, 671 bp, Zea mays
  misc_feature: Ceres CLONE 1415880-F
  misc_feature: Encodes the peptide sequence at SEQ ID NO. 35706
  misc_feature (398)..(398): n is a, c, t, g, unknown, or other
  misc_feature (442)..(442): n is a, c, t, g, unknown, or other
  misc_feature (510)..(510): n is a, c, t, g, unknown, or other
  misc_feature (525)..(525): n is a, c, t, g, unknown, or other
  misc_feature (575)..(575): n is a, c, t, g, unknown, or other
aagctggagctccccgcggtggcggccgctctagaactagtggatcccccgggctgcaggaattcgcacgagaccattacctagaacatcctaatcgaaaaacggcccaccccgatctcataatcgtcgtcttctcccacttcgacgcggctagggccggcgctaccatctcctcttctcttccggcggcttctccgtcccgtcgatcaaccgcgccgccttcgccagtataccccgcattgagccgtcatcgttacctgcgccgaccggcacctctgtagcctcttctccaggggttgcacgaggaggaggaggttcgggcttcgccatgtcgaagtcgaacctagatgatctgcttctgcaggcagccggccggacggggaagaaccactcccggncgagcaacccgcggtggaactctggggggagcgggtccgacggnttcgacgacgacgactcggacgccgcgccgacctactcgaggaagagccttcgtcgcagggtccgctncagaggcggcaccancaaagcagggcggccggcgtggcatgggcggtgggaagacaaggacgacnaggacaagacgggcggtccaagggcggggaggactccgacagccccctccgggggggagggccttatacagggtgggggccacaggaggggctggg

SEQ ID NO: 35706 - protein, 114 aa, Zea mays
  misc_feature: Ceres CLONE 1415880-F
  misc_feature (24)..(24): Xaa is any aa, unknown, or other
  misc_feature (61)..(61): Xaa is any aa, unknown, or other
  misc_feature (66)..(66): Xaa is any aa, unknown, or other
  misc_feature (83)..(83): Xaa is any aa, unknown, or other
MSKSNLDDLLLQAAGRTGKNHSRXSNPRWNSGGSGSDGFDDDDSDAAPTYSRKSLRRRVRXRGGTXKAGRPAWHGRWEDKDDXDKTGGPRAGRTPTAPSGGEGLIQGGGHRRGW

SEQ ID NO: 35707 - DNA, 656 bp, Zea mays
  misc_feature: Ceres CLONE 1415883-F
  misc_feature (198)..(198): n is a, c, t, g, unknown, or other
  misc_feature (216)..(216): n is a, c, t, g, unknown, or other
  misc_feature (254)..(254): n is a, c, t, g, unknown, or other
  misc_feature (405)..(405): n is a, c, t, g, unknown, or other
  misc_feature (577)..(577): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaaattacccccaggccccagcgtgcgtggtctccttcctctcgtggcgacgaccgagcggccgtcgctgcctacgtgcccagtcctgttcgtcccttcgccgncgacggccacgatctggntataggcaaagtttgtcctgaactgttcatcatggtgnaaggctgggtattctctggcttgttaaggggggtttctagcgggtcacaaccacctgggggaggcattctacttggcaggtagttatatgcccccatatcaccaggtgaagaattaggggcgaggggaactctctccctcccatgagaaangactacctttcagtactaaggccttcctactgcccgccagagaaggggttaaaaaagggtgaaaactaagggggctttggagggggaaaaaaaaaaaaattcccccaaccggtcccggggaaaaggaaacaaatttcggatatgggggcacaaccccccccttgcccggggnaaaggagtcggctacgccnnnnnnnnnnnnnnnnnnncggnnnnnnnnnnnnnnnnnnnnnnnnnnnnnnnnnnnnnnn

SEQ ID NO: 35708 - DNA, 701 bp, Zea mays
  misc_feature: Ceres CLONE 1415885-F
  misc_feature: Encodes the peptide sequence at SEQ ID NO. 35709
  misc_feature (440)..(440): n is a, c, t, g, unknown, or other
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcgaaaaattccagtcttttcagaacgagattgcatcgaggaaactacagaaaagggaccaaatcgaatccgtggtgcactgcccctccccctccctcacaagccgccgccgccgtgaggactccggcgaatggcgtcccgcgtcgcctcgggcctcctccgccgccgcgccgtcgccactctagggctactaaggagtcatacacatgtcagaaactacagcagtcaactttcagctttgattccagctacttctcaatgctcaaatctgacaagaagacgctattacttacctaatccatctctgtaccaagtttggagtaggtcatttgcctcagacagcgnagacaagttcgaggctgttgtgcccttcatgggtgaatctgtaactgatggaactcttgctaaacttctaaagaagcctggagacagagtcgaggccgatgaacccatagcgcagattgaactgataagtcactatagatgtcgcaagtcctgaagctggtngtattgaaagctcattgctagtgaggcgacacagttactcaggcactaaaagtgcatcatatcaagtctgctcaactgctgaacacatggtgctcatct

SEQ ID NO: 35709 - protein, 122 aa, Zea mays
  misc_feature: Ceres CLONE 1415885-F
  misc_feature: SWISSPROT Homolog: EC 2.3.1.61 Dihydrolipoyllysine-residue succinyltransferase
  misc_feature (72)..(72): Xaa is any aa, unknown, or other
MASRVASGLLRRRAVATLGLLRSHTHVRNYSSQLSALIPATSQCSNLTRRRYYLPNPSLYQVWSRSFASDSXDKFEAVVPFMGESVTDGTLAKLLKKPGDRVEADEPIAQIELISHYRCRKS

SEQ ID NO: 35710 - DNA, 688 bp, Zea mays
  misc_feature: Ceres CLONE 1415893-F
  misc_feature: Encodes the peptide sequence at SEQ ID NO. 35711
  misc_feature (467)..(467): n is a, c, t, g, unknown, or other
  misc_feature (571)..(571): n is a, c, t, g, unknown, or other
aagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcaaagctccaatccgcccggccgcctccgactgttgccactagctaggtgatcgatcgaatggactgcagtggcgcgctgcagctctcgcctgcgttccgcttccacccagcgatgacgagctggtgatgtactatctcctccgcaagtgcggcgtcctagcgctcgccgcgccgtttatcgtcgaggtgtatctctacaagttcgacccatggcagctcacatagaacgcgatcggtgaagagaaggaatgatacttcttctcgtcgcgcgaccgtagtactcgaatggctcangactaaacagtcggcaggtacatggtactggtaagccaccgcagccgacgagtcgttaggatctccgcggcgcgtgccatcaagaaggcggtcgtcatctacgncgagaagccgccaaaggccgtcagaccactgaatcatggacgagtactgtctcggggaagtacaacgttacggtcgccggacgaaagaggaacaactacgcgtttcagctggatgac

SEQ ID NO: 35711 - protein, 32 aa, Zea mays
  misc_feature: Ceres CLONE 1415893-F
MYYLLRKCGVLALAAPFIVEVYLYKFDPWQLT

SEQ ID NO: 35712 - DNA, 689 bp, Zea mays
  misc_feature: Ceres CLONE 1415908-F
  misc_feature: Encodes the peptide sequence at SEQ ID NO. 35713
  misc_feature (593)..(593): n is a, c, t, g, unknown, or other
  misc_feature (643)..(643): n is a, c, t, g, unknown, or other
  misc_feature (666)..(666): n is a, c, t, g, unknown, or other
  misc_feature (667)..(667): n is a, c, t, g, unknown, or other
  misc_feature (689)..(689): n is a, c, t, g, unknown, or other
aagctggagctccccgcggtggcggccgctctagaactagtggatcccccgggctgcaggaattcgcacgagaccattacctagaacatcctattgaaaaaaaccctaacaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaactgaaagcacacggatcatgcttgttgacaggatgacaaacaatctgtccacagagtccattttctctcgcaaatatcgccttttgggaaagcaagaggctcatgagaatgcaaaaacgattgaagaactttgctttgccttggctgatgagcatttcagagaggagccagagggntgatgggaagttctgctggtcagctatatgcaaaggaacgagcaaagggnttgttgggagttctgaaaaaggnnccaggactactgcagaactggn

SEQ ID NO: 35713 - protein, 78 aa, Zea mays
  misc_feature: Ceres CLONE 1415908-F
MDSAQDFQPRTFSIKLWPPTESTRIMLVDRMTNNLSTESIFSRKYRLLGKQEAHENAKTIEELCFALADEHFREEPEG

SEQ ID NO: 35714 - DNA, 760 bp, Zea mays
  misc_feature: Ceres CLONE 1415911-F
  misc_feature (19)..(19): n is a, c, t, g, unknown, or other
  misc_feature (28)..(28): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (252)..(252): n is a, c, t, g, unknown, or other
tgtgcgccccccccccacnatattcccntctnnnnnnnnnctccnnnnnnccaagctggggctccccgcggtggcggccgctctagaatagtggatcccccgggctgcaggaattcgcacgagaccattacctagaacatcctaatcaaaaaagtggacctcccccgacgactcagtgcgtcttcgccgccgttttcgtcgccgaagataagggtcccctcctctaacacgccggggcttccccccctgccnacgcgacactcagtcgtcgcccgccgtcggctctgctggcgtggccaagcgcgttggcagcgaggattgctttaagttggaggcactttccccaccccccacggccgctgatttccccgtatggggtgaagcccttcccgtgacgggctaatcggctgcctgattctattatgaggggggaggtgtggtcctggttcgcgtctcggaggaccctcgccgtttatcgatccagggaggggagctcccctttctcggttaggcgtgtgtcaggggagagtgttttttacccctcgggaggtggttgaagttgctttcctttggggaaaaatttgggggcagagaaggttttttgaattcaaaggcccccgggggggaatcattttggggaacctcacttccaagggaggaggatttggtcttcggccccttccctaaaaaaactcccaaaaaaccccctccaccccctttaaagggggggggaagagaggttttgccgggtggcttttat

SEQ ID NO: 35715 - DNA, 728 bp, Zea mays
  misc_feature: Ceres CLONE 1415917-F
  misc_feature: Translation starting site: 160
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (353)..(353): n is a, c, t, g, unknown, or other
  misc_feature (354)..(354): n is a, c, t, g, unknown, or other
  misc_feature (395)..(395): n is a, c, t, g, unknown, or other
  misc_feature (399)..(399): n is a, c, t, g, unknown, or other
  misc_feature (400)..(400): n is a, c, t, g, unknown, or other
tggagctccccgcggtggcggccgctctagaactagtggatcccccgggctgcaggaattcgcacgagaccattacctagaacatcctaatcaaaaaaaccttatcggtttatctatccttctatccccattcccatcccgagacaggagagggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcgnnngtggaaggtggtgcgcctggctccacaccccaaagtacagcgccgnngagcgcatcagaagaaaagtacagcgcacgacccccgacancagnntcaggtcggcgacgtcgtcgagctccaaccctcccgtcccatctccaagaaacaagaacttcctcggcatcccgttccggcccgggaaaattggcggaaggtttcaattcctacggccgctccaggccgaaaagaaaaaaggagcctcctccgcagagaggattgattgggaattaattgctccccggaaaagggtttccccaaaaaccctcccccaagagaggggggttcccaaatcaaaaggggaaacacgggggggggtttttaaaaaaattttttcttttttttttcagaaggggttttttccccttttttccccagaaaaggg

SEQ ID NO: 35716 - DNA, 589 bp, Zea mays
  misc_feature: Ceres CLONE 1415921-F
  misc_feature: Encodes the peptide sequence at SEQ ID NO. 35717
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctggcgcaaagctaaacgcgccactcggcgggaagctgctctgctggtccaccaggcaccgaaccgagtgccatggcgactgcagcgagttcgaccccggcggggcgcagcctactctgggctgcgcgtactgaaccgggcggtgcccccggagatgccaaccggaaggtggcccccctgcggggttcgggggccaaaaaggggcggaaattcccgggggggtgggccccgaaaggtttcagaaccatggaggggacctggccccgggggtttt

SEQ ID NO: 35717 - protein, 67 aa, Zea mays
  misc_feature: Ceres CLONE 1415921-F
MATAASSTPAGRSLLWAARTEPGGAPGDANRKVAPLRGSGAKKGRKFPGGWAPKGFRTMEGTWPRGF

SEQ ID NO: 35718 - DNA, 677 bp, Zea mays
  misc_feature: Ceres CLONE 1415926-F
  misc_feature (356)..(356): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (405)..(405): n is a, c, t, g, unknown, or other
aaagctggagctccccgcggtggcggccgctctagaactagtggatcccccgggctgcaggaattcgcacgagaccattacctagaacatcctaatcaaaaattcctcttgctcttcctcttccattcattagctgcactcgcctccctcgcgccaccgccttctcagccaccaccgccgcgggtgcctcagaaagtgcaggtgtggcccaagccggtgtcccatttctcggtggccgttgccggcatacgcgccgatctccccgtcgttcaacatccgcgcctcgccgtcgcacccgtcgctccgtcacgccatcgcgtactacacccgcctcatccgcaccgagcgggtacacngnnnccggaaatttaatccccccccccccgtccaaacctaaccacccgntcttcgggggcggtccccccattccgggccttggtttcggggggttttttcccggtctttccccaaatatccccgaaagtcccccggcttgggggccccccggggggttaaaaaaaaagttctaaaaaaagggttttttccgggggggcacccccaaattttccccggccccccgggtgaaaaatattttttggggcggccacccctccctctggggggggggggaaaatttttccccccgcggggggtttttaaaaaaaaactctctttcc

SEQ ID NO: 35719 - DNA, 694 bp, Zea mays
  misc_feature: Ceres CLONE 1415927-F
  misc_feature: Encodes the peptide sequence at SEQ ID NO. 35720
  misc_feature (483)..(483): n is a, c, t, g, unknown, or other
  misc_feature (487)..(487): n is a, c, t, g, unknown, or other
  misc_feature (493)..(493): n is a, c, t, g, unknown, or other
aaagctggagctccccgcggtggcggccgctctagaactagtggatcccccgggctgcaggaattcgcacgagaccattacctagaacatcctaatcgaaaaatcaataaaaaccctagcagatccacccgtcacccgaagcttcctcctcgcagcgcgccgcgcgtcgtcgcctctacccaccggacttcgcgcgccacgacgagcctgcgagccatcagcccatcacccacccacccccccgccacgcagatctagggagcttaccctcccaccgggcggtcattcttccgtcccatcaccgatgcggacgccggcgatgctccggtgggccgcggcgctcgcggtcctgctcgctgtcgccgcgccgggccgcgggttctacctccccgggcgtgccccgagcgatttcgcgaagggtgatccgcttccagtgaaggtgataaagtgacatctatcaaggactcactcccgatacatatnattncccttncgtctgcaagccagataccatagtcgacggggcgaaaatcttggggaaggacttcggggcgatccgattggaaattctcttattggggtcaaaatggaaaagccccagatggggtcaaattgtttggaaagccccgttccttggaaaagagccggggggttccgggaaaaaataaggggcccaatccggtgggaaattgtt

SEQ ID NO: 35720 - protein, 48 aa, Zea mays
  misc_feature: Ceres CLONE 1415927-F
MRTPAMLRWAAALAVLLAVAAPGRGFYLPGRAPSDFAKGDPLPVKVIK

SEQ ID NO: 35721 - DNA, 695 bp, Zea mays
  misc_feature: Ceres CLONE 1415933-F
  misc_feature: Encodes the peptide sequence at SEQ ID NO. 35722
aaagctggagctccccgcggtggcggccgctctagaactagtggatcccccgggctgcaggaattcgcacgagaccattacctagaacatcctaatcgaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatgggcactcaccaacattgc

SEQ ID NO: 35722 - protein, 145 aa, Zea mays
  misc_feature: Ceres CLONE 1415933-F
  misc_feature (4)..(97): Pfam Name: IBB Pfam Description: Importin beta binding domain
  misc_feature (106)..(145): Pfam Name: Arm Pfam Description: Armadillo/beta-catenin-like repeat
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVVPRFIEFLTREDHPQLQFEAAWALTNI

SEQ ID NO: 35723 - DNA, 659 bp, Zea mays
  misc_feature: Ceres CLONE 1415935-F
  misc_feature (439)..(439): n is a, c, t, g, unknown, or other
aaagctggagctccccgcggtggcggccgctctagaactagtggatcccccgggctgcaggaattcgcacgagaccattacctagaacattctaatcgaaaagaagggaaaagcattccaacgctgcatctgcactgcacggtacttcctcctcctcatcctcctctatctctaagaatttaaaagagaagaagggggaagtcctcgactgctcgttccataaaccctaacctcgttggattcgcggcaaaaatcctcccaattcggaaccctccgatgttccagctacctgcgggagctgagccgtgctcggtttggcgaaattttgcacccctcttgtgctaggaccacccggttcaagctgttcctcggaaggatcaggtcttcaccggtgctctccggcgccggatccaggtttgttccggcgagaggtcgggcntcttggtgggggccagcccagcttcgagctcaatttgccggcctgagatggaatcgcgactgcggtgccgggtgccggtggctcagctagtcgcgtcgagtcgacgcgcgattctgcccaatttgggtgggccagcctttctgcaatctccggggggggcgtttcgcctcgcggcgtggcaaaaaggggggtggacgtgtgatgcatcccaaggctcgaa

SEQ ID NO: 35724 - DNA, 712 bp, Zea mays
  misc_feature: Ceres CLONE 1415939-F
  misc_feature: Encodes the peptide sequence at SEQ ID NO. 35725
  misc_feature (146)..(146): n is a, c, t, g, unknown, or other
  misc_feature (407)..(407): n is a, c, t, g, unknown, or other
  misc_feature (422)..(422): n is a, c, t, g, unknown, or other
  misc_feature (436)..(436): n is a, c, t, g, unknown, or other
  misc_feature (557)..(557): n is a, c, t, g, unknown, or other
aagctggagctccccgcggtggcggccgctctagaatagtggatcccccgggctgcaggaattcgcacgagaccattacctagaacatcctaatcgaaaacttctgccattccgccgaacaccttccccaatcgtgcgcctccggncatgggggaagcctccgacgcggcggtagccgtatctgcgcggctcctggagctggcgggcgaagacgactctgcagcgctcggtgacctccttggggcacacccgtcgcttggtgacgagcccgggccggggtactccccggcgggcggggcggagcctatgaccccgctcatggtcgcggcggcgtacgggtccggggcctgcatcgatgtgctactctctcccgccccacagagcgaggcccagcgcgcctcaccgtnggtcctctccacggngcttatcttgcagngcgggggggggcctccgctgcgccgggtgcggtatcccgtctcctagctgctggggccgaccccacgtggttcgaccacctccatcgccgaacggtcgaaggtgtcacccctcccacccanttcgctcccgttaaagacccactttctctctctctccgagggcgcaagggagtggccgccggattcctccctccccgacatcaagaatggtggcttacggcttcgacgactttcggatgtatcccttcaagggggggggggtgtcgcgggctacc

SEQ ID NO: 35725 - protein, 111 aa, Zea mays
  misc_feature: Ceres CLONE 1415939-F
  misc_feature (87)..(87): Xaa is any aa, unknown, or other
  misc_feature (92)..(92): Xaa is any aa, unknown, or other
  misc_feature (97)..(97): Xaa is any aa, unknown, or other
MGEASDAAVAVSARLLELAGEDDSAALGDLLGAHPSLGDEPGPGYSPAGGAEPMTPLMVAAAYGSGACIDVLLSPAPQSEAQRASPXVLSTXLILQXGGGPPLRRVRYPVS

SEQ ID NO: 35726 - DNA, 690 bp, Zea mays
  misc_feature: Ceres CLONE 1415948-F
  misc_feature: SWISSPROT Homolog: EC 5.3.1.9 Glucose-6-phosphate isomerase
aaagctggagctcaccgcggtggcggccgctctagaactagtggatcccccgggctgcaggaattcgcacgagaccattacctagaacatcctaatcgaaaactcctttccaagacaatcagcgaacgaaacgaaccctaagcaaatcgaggtagaggggtggcccgatctcggtggctactgattatcggccgcccttcccgcgccgcggtctgcgctttggacggtcctgcggcgccttgacatccgcccgggtccccgtcaaccatataaactgaatatccaattcaaagggcggggagcgtacgtgtaccaccaccgacttccggccgtccaccgtttccagcacacagggtaaaggcaagcaaacgagcggcgggacggctagcccgcaataacacaatgcggaggaactaccaggcggcgacaagaagatccgtctcccacgaacggcgatagctatcgaccttgtatcgccacgccctggcgtccgaaacgataatctgcggcacggagcaatggaaggacctccaggcgcacgttggcgtgatccagaaaacgcacctgtgcgacctgatgggccgacgcccacccgatgcaagcgcattgacgcctcgatcccgaaggcgatcttcctgggattcccctaaaccccctgggtacctgtttgacaaccctggaacaacttcc

SEQ ID NO: 35727 - DNA, 702 bp, Zea mays
  misc_feature: Ceres CLONE 1415953-F
  misc_feature: Translation starting site: 177
  misc_feature (248)..(248): n is a, c, t, g, unknown, or other
  misc_feature (266)..(266): n is a, c, t, g, unknown, or other
  misc_feature (378)..(378): n is a, c, t, g, unknown, or other
  misc_feature (447)..(447): n is a, c, t, g, unknown, or other
  misc_feature (448)..(448): n is a, c, t, g, unknown, or other
  misc_feature (473)..(473): n is a, c, t, g, unknown, or other
aagctggagctccccgcggtggcggccgctctagaactagtggatcccccgggctgcaggaattcgcacgagaccattacctagaacatcctaatcgaaaagtttttcctgatctcgcctcccgagccacacacgttgccgccgtgagccgccgcccacaaggctaagcaccaaccatggccttcggagctctcgtcacgtcgaggctgggcaggtcccggcgcacccttgcatctgccgttgcccanggtcccgttgcccagcgnatagcacctcctctgctctccaggcttggagcagtagctcgtcttctcagcacaaagccagccgcaacagatgtcatcggtatcgatctaggcactacgaattcctgcgtcntcgtcatggaagaaagacaccacgggtgattgaaaatgcagaaggcgcgaggacgacaccctccattgnntgcaagaatcagaatggtgacctgntgattgtatcacagcgagccgggaggcagtaaccaatgcccagaacacatccgtgggtcaaagcgtcttatcggtaggacttttgatgaccccagacccagaggagatgaagatggtgcttacaagttgtcaagccgcgaaatgtgatgcctgggtcaagatgggtgccagagtaccccctagcagattggggatttgtctcactaagatgaggaactgcagagctacc

SEQ ID NO: 35728 - DNA, 672 bp, Zea mays
  misc_feature: Ceres CLONE 1415954-F
  misc_feature: Encodes the peptide sequence at SEQ ID NO. 35729
  misc_feature (375)..(375): n is a, c, t, g, unknown, or other
  misc_feature (576)..(576): n is a, c, t, g, unknown, or other
  misc_feature (672)..(672): n is a, c, t, g, unknown, or other
tggagctccccgcggtggcggccgctctatcactagtggatcccccgggctgcaggatattcgcacgagaccattacctagaacatcctaatcgaaaaatcacgaagagtcatcacgccatacgacacggaggacaccgagccggaggcgaagccggtgcgcagcgcgagagtagcggcgagtcggcgaccatcaagcaactgcatggccgcgttacccgccagcacccccgcccccgcccccgccccctccgaggcggcggagctcgtgccgacgctctcctcgctggagccggtctacggcgcgggcgcgcagctcgacgaggcgcgcctccgcttcgcccgcctcggagaccgcttccacgccgtctacggngcccgccccgcgctcttcgcccgctccccagggagggtcaatctgatcggggagcacatcgactacgagggctactcggtggtgccgatgggcatcccgcaggacatgatcgtcgccatccgaagggccacggcgcccaggtgagggtcgacaacgtcgacgaacagtaccccctctgcgtctacccccgccgaccagacnaggtatttgacgtaaaaatcacaaatgggggcactatttcatgtgtggatacaagggaggttatgaatactgcagatccaaagggatagatctggn

SEQ ID NO: 35729 - protein, 104 aa, Zea mays
  misc_feature: Ceres CLONE 1415954-F
  misc_feature: SWISSPROT Homolog: EC 2.7.1.6 Galactokinase
MAALPASTPAPAPAPSEAAELVPTLSSLEPVYGAGAQLDEARLRFARLGDRFHAVYGARPALFARSPGRVNLIGEHIDYEGYSVVPMGIPQDMIVAIRRATAPR

SEQ ID NO: 35730 - DNA, 677 bp, Zea mays
  misc_feature: Ceres CLONE 1415956-F
  misc_feature: Encodes the peptide sequence at SEQ ID NO. 35731
  misc_feature (307)..(307): n is a, c, t, g, unknown, or other
  misc_feature (374)..(374): n is a, c, t, g, unknown, or other
aaagctggagctccccgcggtggcggccgctctagaatagtggatcccccgggctgcaggaattcgcacgagaccattacctagaacatcctaatcaaaaccagatccctcttccctctccgctcccccacgtcatctagtcgccgcccccgctcaccgattgtcctctgctgtggagcgagcaagcagcggcgaagcgatggaggaggagatcagaaaggagttccagagtaacggcttctccatcggaggagccggccccgaggacgccgcccagatcctctccacgctgctgacctactgcatncactacaagatgagccccgcggatctcgtctcagactgggaggtctactacccctcatagcattggnatggctttaaagctcgaagctcgtatcttgatggttttctgtcacacctttcaaatgggagtaaagacaggataataaaaagagaagctaacccttcacattttactcaggtaacgattgttgacatgcttcttaagccatttcccatggtagatggaagcagcctttccctgggaccccccccagggtttataaacaggggaaaagggcccccctgaagggaatctttctatttctttgggagaaaacccccccccccggaagggggggggaaaaccacttctctccccccgggaggggggg

SEQ ID NO: 35731 - protein, 55 aa, Zea mays
  misc_feature: Ceres CLONE 1415956-F
  misc_feature (36)..(36): Xaa is any aa, unknown, or other
MEEEIRKEFQSNGFSIGGAGPEDAAQILSTLLTYCXHYKMSPADLVSDWEVYYPS

SEQ ID NO: 35732 - DNA, 683 bp, Zea mays
  misc_feature: Ceres CLONE 1416069-F
  misc_feature: Encodes the peptide sequence at SEQ ID NO. 35733
  misc_feature (377)..(377): n is a, c, t, g, unknown, or other
ggagctccccgcggtggcggccgctctagaactagtggatcccccgggctgcaggaattcgcacgagaccattacctagaacatcctaatcgaaaaatccccctctgctacgctttgttctgggctcttcctggctgcctcctcttcctcctcccctgtacagagagagagaacccagagagagggagcgggctctgagagaacgggagatggggaacatctgcggtggctccgggaaagatcgggtggccgaagatttcaggccgtctagcccagggacaaacatgacctccaagacgagcggcagcataaccaccagcctgagcaccacgggggaagctctcctcccgtgggcacagcttcatggcgtccgccgnaaggcgaagaacagggggggattcgacgagggggccagtactccgacggcagatcctccaaggggccaacctccggacttccaattcgtagaggtcaagaccggcaccagaatcttcgggccgaaaaggtccctttgggaaggagggttcggaaaagccaacaaaggggggtggaataaaaaaacttgggcccaaccaaaaaaagacccggatgggtttttgggcaaaaaaacccatttccaaaaatggaggggtttaaaaaagggaccccaaaaaaattttttaaagaggttccccctccaaaca

SEQ ID NO: 35733 - protein, 158 aa, Zea mays
  misc_feature: Ceres CLONE 1416069-F
MGNICGGSGKDRVAEDFRPSSPGTNMTSKTSGSITTSLSTTGEALLPWAQLHGVRRKAKNRGGFDEGASTPTADPPRGQPPDFQFVEVKTGTRIFGPKRSLWEGGFGKANKGGWNKKTWAQPKKDPDGFLGKKTHFQKWRGLKKGPQKNFLKRFPLQT

SEQ ID NO: 35734 - DNA, 705 bp, Zea mays
  misc_feature: Ceres CLONE 1416071-R
  misc_feature: SWISSPROT Homolog: EC 2.4.2.9 Uracil phosphoribosyltransferase
tcgaggtcgacggtatcgataagcttttttttttttttttttcggagcatatcatattttatctcatgactatcccgtaaacaatatggatcaaacgcacttatttgaaaacattaatgtttctgcacccatccaagacaaaatacaaaccacgttctccgattacaggttctactctagcatccagctgaccttggtcaagctttatgcagaaggtcctacaggttaccaaggcatgcccactactaaacacaatcacgccttatagtgatacgatccatcaattgtctgagccgaagccgcggtcgccatattctcccaatcctgggatcaccctgcaattcctcgttgatagcataaacgatttcagatgtcattatctacagccacccaaccgtcgtgcagatatattgaatcccttcaggatccgagatgagattgacaaaaatgatccgatcctcacgaataccttttctcataataaggccactggcatgggctactgagttacatgtaccaatcaccatatcccaaataagaacatgtccgttcaaaaattcccatgggcagtgttgtgataaacaagctgccgcccgttgtccgccaactataaatcaactcaaaattttcccaaatttttattcctaataaacaaggacggccccgagcttaaccatatttcaatccacttccgcgctatacaaa

SEQ ID NO: 35735 - DNA, 688 bp, Zea mays
  misc_feature: Ceres CLONE 1416071-F
tggagctccccgcggtggcggccgctctagaactagtggatcccccgggctgcaggaattcgcacgagaccattacctagaacatcctaatcgaaaagtacacaagctcgactcgcaacagtgatgcgcgaatcagtcccgaatcccgatcgaccggcgccgcgttacgccacgccggataaggcgtcggattacgtcgtggacgccgcgaagggggctcactctcactgcgctccggctctaggcgctgagactctccacctctgcggcctcttcctcttcgtcctcccccgacgacgaggaggagaagcactacaacggagacgcttacgccaacgggacgatcgagattccctcttctgccgctgccctgcagccattagtcgtcgccgtttctgctagcacgtcgctggggactacgacgcctcgcgacatgaacatcccggacatgcacgaacaccgagtgaggctccatccctccgcagtcgagttaccggagcaccgactgttgacctaggcgggccctgcaccagccctatcggatttggaccccccccgacgccgtttggtaccaacgaacccttcctaatactgctagagagggcctgccggcagtgcgcctccacccctggcaaagggtcttgcaaatccctaggggcttaaaggaacaccttccggaggatgggtt

SEQ ID NO: 35736 - DNA, 721 bp, Zea mays
  misc_feature: Ceres CLONE 1416074-F
  misc_feature (170)..(170): n is a, c, t, g, unknown, or other
tctcccccttcacccttaacccgcccgttttcaatccccccctctccttatgaaccccccaacccggcggggcccccacccaaccccccccaccccccctcccttcctcttattatttacaagctggggctccccgcggtggcggccgctctagaactagtggatccccncgggctgcaggaattcgcacgagaccattacctagaacatcctaatcgaaaaaaactcacagcacaaacgttcctctcctcttccatcgtcgtcctcgctcccggccccgcctgtctagtctagtccccctctttctcgcgtgcaacccctgtactgtacgtgctaggcacacagctagctgcagctaccgcaaggcagcaaatgggttctggtggcgggccatggtgggaacggggggggcaaacaacagggaaggcccgtccaactttccgggggcacccccggggggaaaaagtccagggaacccgagggcttgggtttggctcccccggtttttaatccccggggccccccgaaatttgggggggaaaccccccgggggccccccaaatgggccactccccccctgggaaacccggggggggagccaaccccccccggggggggggggtgggggacaccctcttccaaactatcccaaaaatccccgccaccccccgggggggggcccacacattttccttggggggggcccccctccccccctccc

SEQ ID NO: 35737 - DNA, 692 bp, Zea mays
  misc_feature: Ceres CLONE 1416075-F
  misc_feature: Encodes the peptide sequence at SEQ ID NO. 35738
  misc_feature (252)..(252): n is a, c, t, g, unknown, or other
  misc_feature (301)..(301): n is a, c, t, g, unknown, or other
  misc_feature (325)..(325): n is a, c, t, g, unknown, or other
  misc_feature (343)..(343): n is a, c, t, g, unknown, or other
  misc_feature (369)..(369): n is a, c, t, g, unknown, or other
  misc_feature (383)..(383): n is a, c, t, g, unknown, or other
  misc_feature (525)..(525): n is a, c, t, g, unknown, or other
ggagctccccgcggtggcggccgctctagaactagtggatcccccgggctgcaggaattcgcacgagaccattacctagaacatcctaatcgaaaataccttcaataagaatggctccatgatatttctggatttgtcatttaatcagcttgactcagagatcccaaaggagcttgggaacatgtactacctcatgatcctgaatcttggccacaacttgctgtctggcgtcatcccaccagaactagctgntgccaagaagcttgctgtactcgacctgtcacacaaccagttggaaggncctattccccactctttctcgacngtgtcctttgtcgagatncacctttcaataatcagttgaatggntcatttcagagctncgttcgctgttcacatttccgagatttcatatgagaataactctggtcttttgtgcttcccactggtgccatgcgggcaccatgcttgctcaagttctccgatggccaccgatccccaacggaccaggcttcacttcggggnaagggttggtatgggactcttggtccccgtggtcctgaaagtgggaatggcatcctaagttgttgagggccaaaacggaaaccaattcatgaaaggccatttccctcccggaaaaaaactttggaagccggtcttttttgggaatatgaaattccattgggaaccct

SEQ ID NO: 35738 - protein, 81 aa, Zea mays
  misc_feature: Ceres CLONE 1416075-F
  misc_feature: SWISSPROT Homolog: EC 2.7.11.1 Non-specific serine/threonine protein kinase
  misc_feature (45)..(45): Xaa is any aa, unknown, or other
  misc_feature (75)..(75): Xaa is any aa, unknown, or other
MIFLDLSFNQLDSEIPKELGNMYYLMILNLGHNLLSGVIPPELAXAKKLAVLDLSHNQLEGPIPHSFSTVSFVEXHLSIIS

SEQ ID NO: 35739 - DNA, 691 bp, Zea mays
  misc_feature: Ceres CLONE 1416076-F
  misc_feature: Encodes the peptide sequence at SEQ ID NO. 35740
  misc_feature (247)..(247): n is a, c, t, g, unknown, or other
  misc_feature (254)..(254): n is a, c, t, g, unknown, or other
  misc_feature (301)..(301): n is a, c, t, g, unknown, or other
  misc_feature (334)..(334): n is a, c, t, g, unknown, or other
  misc_feature (360)..(360): n is a, c, t, g, unknown, or other
  misc_feature (406)..(406): n is a, c, t, g, unknown, or other
  misc_feature (427)..(427): n is a, c, t, g, unknown, or other
  misc_feature (483)..(483): n is a, c, t, g, unknown, or other
  misc_feature (529)..(529): n is a, c, t, g, unknown, or other
tggagctccccgcggtggcggccgctctagaactagtggatcccccgggctgcaggaattcgcacgagaccattacctagaacatcctaatcgaaaaccgcacacctctgacctccctccgtccatctcatcatcatctttgtccctctcgcgcaattcgccgaacacaccgcgcgcgcctcgcctcccagcgacggccgcctcgacggccaatgctggcgccggaatgagcgtgaaggagaagtgnagcgcgngaaagagaacctgtctacgagtcgctcgaccgcatcctctcctcgtncggctcctcaccctctgctcggacgacgatggngccgaacgccccgcgcacgccgcagntgggatgcgccagccgcagcggccctcgacctgtggacctcccagncggcgccccgtcatgagcggnggcgccggctgctccatctcatggggctcaccggcgatcctttccctcgcggattngagattgcccggtccgcctccggagaagccgggggacgcccccggnctctcccgtctcgtggtccaagtcaggcggggccgcccctggctccgccgggaaagccgcgctcggggggcggccgcttgccctcctcctgtccgacgggtcccatgcccgcccagaggcactcaagggcctgatcagggaaccccaccacggcaaaaagta

SEQ ID NO: 35740 - protein, 71 aa, Zea mays
  misc_feature: Ceres CLONE 1416076-F
  misc_feature (12)..(12): Xaa is any aa, unknown, or other
  misc_feature (28)..(28): Xaa is any aa, unknown, or other
MGLTGDPFPRGXEIARSASGEAGGRPRXLPSRGPSQAGPPLAPPGKPRSGGGRLPSSCPTGPMPAQRHSRA

SEQ ID NO: 35741 - DNA, 674 bp, Zea mays
  misc_feature: Ceres CLONE 1416084-F
  misc_feature: Encodes the peptide sequence at SEQ ID NO. 35742
  misc_feature (370)..(370): n is a, c, t, g, unknown, or other
  misc_feature (382)..(382): n is a, c, t, g, unknown, or other
  misc_feature (387)..(387): n is a, c, t, g, unknown, or other
  misc_feature (393)..(393): n is a, c, t, g, unknown, or other
  misc_feature (395)..(395): n is a, c, t, g, unknown, or other
  misc_feature (403)..(403): n is a, c, t, g, unknown, or other
  misc_feature (410)..(410): n is a, c, t, g, unknown, or other
  misc_feature (416)..(416): n is a, c, t, g, unknown, or other
  misc_feature (435)..(435): n is a, c, t, g, unknown, or other
  misc_feature (460)..(460): n is a, c, t, g, unknown, or other
  misc_feature (461)..(461): n is a, c, t, g, unknown, or other
  misc_feature (467)..(467): n is a, c, t, g, unknown, or other
  misc_feature (468)..(468): n is a, c, t, g, unknown, or other
  misc_feature (480)..(480): n is a, c, t, g, unknown, or other
  misc_feature (482)..(482): n is a, c, t, g, unknown, or other
aagctggagctccccgcggtggcggccgctctagaactagtggatcccccgggctgcaggaattcgcacgagaccattacctagaacatcctaatcgaaaaatggcatctgcattgcagttgcagccacgccaacaactgggcagcggcgacatctgcatctcccacctcgtctccctcccgtatctgcaagccttgatcccgccgccagccatccatccaagggagccatgtctccatccggcgagctgctggcttccatctcctccgtcttcactgtcgccttcgtcctcctcgcctgcgtcgagctcggcgacgccgcccgcgccgccgtcggcgtctaccgccctcatcagtacgaactcgccggngctccgctcggnttccngcgcgngntcctcaancacacgntgccgngttcccgcttcccggcggngaagaactctccccgtcgcctcgtnngggcgnntcttggactccngntctctttcctcaaaaagacctggtggaaaaaaaacatctggggggattactcatccgctcccgacaaatatgacgggggggaggacaaggggaaattcaaagggggactgactgaccgtaaaaaattgttctgcataaacaatttcaaaacccgggattttgtttggagagacaaatttgaaaaccggggga

SEQ ID NO: 35742 - protein, 148 aa, Zea mays
  misc_feature: Ceres CLONE 1416084-F
  misc_feature (53)..(53): Xaa is any aa, unknown, or other
  misc_feature (55)..(55): Xaa is any aa, unknown, or other
  misc_feature (56)..(56): Xaa is any aa, unknown, or other
  misc_feature (58)..(58): Xaa is any aa, unknown, or other
  misc_feature (61)..(61): Xaa is any aa, unknown, or other
  misc_feature (63)..(63): Xaa is any aa, unknown, or other
  misc_feature (69)..(69): Xaa is any aa, unknown, or other
  misc_feature (78)..(78): Xaa is any aa, unknown, or other
  misc_feature (80)..(80): Xaa is any aa, unknown, or other
  misc_feature (84)..(84): Xaa is any aa, unknown, or other
  misc_feature (85)..(85): Xaa is any aa, unknown, or other
MSPSGELLASISSVFTVAFVLLACVELGDAARAAVGVYRPHQYELAGAPLGFXRXXLXHTXPXSRFPAXKNSPRRLVXAXLGLXXSFLKKTWWKKNIWGDYSSAPDKYDGGEDKGKFKGGLTDRKKLFCINNFKTRDFVWRDKFENRG

SEQ ID NO: 35743 - DNA, 702 bp, Zea mays
  misc_feature: Ceres CLONE 1416090-F
  misc_feature: Encodes the peptide sequence at SEQ ID NO. 35744
  misc_feature (408)..(408): n is a, c, t, g, unknown, or other
  misc_feature (414)..(414): n is a, c, t, g, unknown, or other
  misc_feature (437)..(437): n is a, c, t, g, unknown, or other
  misc_feature (439)..(439): n is a, c, t, g, unknown, or other
  misc_feature (665)..(665): n is a, c, t, g, unknown, or other
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttccgccgagcccgccgtcgtacgggttcgagcagccggcgccgcttccggccctggcacacccgagcctccggccccggccacatccaagccgccgcctccggccccggccacacccaagccggccgcctccggncccggncacacccaagccgcccccagggnangaaggaaaagggcggtggccccgttgttgaacctcacggcggtcccgcggaaggtttaacgtggaaggcccggcgcttgcgaaccaaccggggccaggaggtgggcccaaagcaccgtgcgccaggggggggaccaaggtcacgttggtctactcccagggaaagccggccgacctcgggcaagatgaacgagctctttcgggaggttcggccccaccctcagggnaaacttgatggggaaatgaatattctgggtatgggcn

SEQ ID NO: 35744 - protein, 157 aa, Zea mays
  misc_feature: Ceres CLONE 1416090-F
  misc_feature (60)..(60): Xaa is any aa, unknown, or other
  misc_feature (62)..(62): Xaa is any aa, unknown, or other
  misc_feature (70)..(70): Xaa is any aa, unknown, or other
MGAVTSTVAARFAFFRRARRRTGSSSRRRFRPWHTRASGPGHIQAAASGPGHTQAGRLRXRXHPSRPQGXKEKGGGPVVEPHGGPAEGLTWKARRLRTNRGQEVGPKHRAPGGGPRSRWSTPRESRPTSGKMNELFREVRPHPQGKLDGEMNILGMG

SEQ ID NO: 35745 - DNA, 738 bp, Zea mays
  misc_feature: Ceres CLONE 1416101-F
  misc_feature: Encodes the peptide sequence at SEQ ID NO. 35746
  misc_feature (220)..(220): n is a, c, t, g, unknown, or other
  misc_feature (221)..(221): n is a, c, t, g, unknown, or other
  misc_feature (242)..(242): n is a, c, t, g, unknown, or other
  misc_feature (243)..(243): n is a, c, t, g, unknown, or other
  misc_feature (314)..(314): n is a, c, t, g, unknown, or other
  misc_feature (454)..(454): n is a, c, t, g, unknown, or other
aagctggagctccccgcggtggcggccgctctagaatagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccacagcccnnacagatcagagggagtgatgnncgagagtgacagctgcctggcgcgcgtgggtgcccgaattgctatcggtggcgcggtcggcggagccgtcngtaaccttcgtccctaaccccctaacactaggcttgcagcatcaatccgtccgtgcgagccgcttcacccgtcggtgttttttttttttggtggaagtagattagtggcgatttcaggaaatcttctcgagctagctagnagctacatcccctggtttgggggggtagctagcggcaaatgtaataactagggggcttttgtaaaaagtactagggcttaaggaacatcatctggagggtggaaaaaatcgatgcctccagtgggagtttgtttccccccattgcttggggctcaaagggtttttgctaattccggcctgcccggggtttggtaaaactcccgggtgggggttaaaaaattggggaggaaaaagggaaaaattttggttttccccttggattttgacgaaaggaagggcttcca

SEQ ID NO: 35746 - protein, 30 aa, Zea mays
  misc_feature: Ceres CLONE 1416101-F
  misc_feature (2)..(2): Xaa is any aa, unknown, or other
  misc_feature (26)..(26): Xaa is any aa, unknown, or other
MXESDSCLARVGARIAIGGAVGGAVXNLRP

SEQ ID NO: 35747 - DNA, 729 bp, Zea mays
  misc_feature: Ceres CLONE 1416111-F
  misc_feature: Encodes the peptide sequence at SEQ ID NO. 35748
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (23)..(23): n is a, c, t, g, unknown, or other
  misc_feature (31)..(31): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nggggccccccnnnnnnnnccnngaaatacnagaggggaaaccccnnnccaaagctggagctccccgcggtggcggccgctctagaactagtggatcccccgggctgcaggaattcgcacgagaccattacctagaacatcctaatcgaaaacttccagttccagatcccataattgcacgcgacactacaccgcccccttccgcaagtcagagggacattgcattggggaactacagaaaagggtccgaatcgaatccgtggtgcactgccccttcctcccccacaagccgccgccgccgccgtgaggactccggcgaatggcgtcccgcgtcgcctcgggcctcctccgccgccgcgccggcgccacactaggcctcctaaggagttatgcacatgtcagaagctacaacagtcaactttcagctttggtttctgctacatctgaatgctcaaatctgccgagaagatgctattacttacctaatccctctccataccaagtttggagtaggtcatttgcttcagacaacggagacaagtttgaggctgttgtgcccttcatgggtgaatctgtaactgatgaaactcttgctaacttcttaaagaaacctgaagacagagtcgaggctgatgaacctattgcgcagattgaaactgataagtccactataaaatgtcgcaagccctggaagcttgtggttaattgaaaagctcattggctagggaa

SEQ ID NO: 35748 - protein, 129 aa, Zea mays
  misc_feature: Ceres CLONE 1416111-F
  misc_feature: SWISSPROT Homolog: EC 2.3.1.61 Dihydrolipoyllysine-residue succinyltransferase
MASRVASGLLRRRAGATLGLLRSYAHVRSYNSQLSALVSATSECSNLPRRCYYLPNPSPYQVWSRSFASDNGDKFEAVVPFMGESVTDETLANFLKKPEDRVEADEPIAQIETDKSTIKCRKPWKLVVN

SEQ ID NO: 35749 - DNA, 637 bp, Zea mays
  misc_feature: Ceres CLONE 1416112-F
  misc_feature: Encodes the peptide sequence at SEQ ID NO. 35750
gctctagaactagtggatcccccgggctgcaggaattcgcacgagaccattacctagaacatcctaaaaaaaaactatcggatcttgcgaaggcatcgtcctcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcgggcgtcggggggctcttccgcgcgagcccgcgctacgggcgcttgcaagccacggcggcagttgaccctgaagatatccaattgaggaagggtcaagttaaatcctcaggacatgttctgcaatatgttggcgttgctttgtttggggctaattcttgtttggtacccatcttgggtgtggggcaatggggcacttgaatacctcgccaagggatctttgggattgctgaaatgctgcctttggcgggggggg

SEQ ID NO: 35750 - protein, 80 aa, Zea mays
  misc_feature: Ceres CLONE 1416112-F
MMRCAATGGGCVASWSGDRRLPAVNPCSVRMPTGNDGWCAGLRSRAADLAGLEMANLRGGRRGALPREPALRALASHGGS

SEQ ID NO: 35751 - DNA, 666 bp, Zea mays
  misc_feature: Ceres CLONE 1416114-F
  misc_feature: Encodes the peptide sequence at SEQ ID NO. 35752
aagctggagctccccgcggtggcggccgctctagaactagtggatcccccgggctgcaggaattcgcacgagaccattacctagaacatcctaatcgaaaaaaaaatatgataacacatcaattgccagtcgtcgtccccaccgctggccgcgcggaagcccgcgaagatgtccctcggcgggaccagcggcccgcgcgtctgcgcccggatctgcaagctcgccggacgccgccagcggatgctcctccgcctcctcgtctccgtcgccgtggcattctgcttcctcttctcatcacttgtcagtaaagacgaagatgcatcacctggtgttgagaccatgcttgtgttttctgatcatgtccggagctttgtgaaccctgtttggacatcgtcaggcagaccagctgatagaaaacgcactggaccacgaccttgtccagtttgttatttgccagttgagcaagcactggcactgagaccagctaaaccatcattgtcaccagtccttcaaagcttaaattatgttcttgaagagattttgattcctaaagagtccaagagcggttctttgtttggaggttttccatccctggaggaacgagataagtcttatgacataaaagactcgatgagtgtacattgtggatttgtcagagcgaaggag

SEQ ID NO: 35752 - protein, 166 aa, Zea mays
  misc_feature: Ceres CLONE 1416114-F
MSLGGTSGPRVCARICKLAGRRQRMLLRLLVSVAVAFCFLFSSLVSKDEDASPGVETMLVFSDHVRSFVNPVWTSSGRPADRKRTGPRPCPVCYLPVEQALALRPAKPSLSPVLQSLNYVLEEILIPKESKSGSLFGGFPSLEERDKSYDIKDSMSVHCGFVRAKE

SEQ ID NO: 35753 - DNA, 697 bp, Zea mays
  misc_feature: Ceres CLONE 1416121-F
  misc_feature: Encodes the peptide sequence at SEQ ID NO. 35754
  misc_feature (488)..(488): n is a, c, t, g, unknown, or other
  misc_feature (508)..(508): n is a, c, t, g, unknown, or other
  misc_feature (617)..(617): n is a, c, t, g, unknown, or other
  misc_feature (642)..(642): n is a, c, t, g, unknown, or other
  misc_feature (643)..(643): n is a, c, t, g, unknown, or other
  misc_feature (655)..(655): n is a, c, t, g, unknown, or other
  misc_feature (670)..(670): n is a, c, t, g, unknown, or other
aagctggagctccccgcggtggcggccgctctagaactagtggatcccccgggctgcaggaattcgcacgagaccattacctagaacatcctaatcgaaaaagaaccttctagaccaaaccttcgacccatcacctcgagctccagccatgtcgctctcgtcggcgcgccagcgtcgggccacggcagcgtcgccaccgacagatgatgggtacgccaaggacgccaaggacaggaggcggcggcccggcggagacggggacagcgaggacgagggtatcaagtggttcctcccgttcctggcgctcgggctcctccgccacatgagcgcgtcctccaacctgatccacgactgcgacgaggtcttcaactactgggagcccctccacttcctcctctaccgctccggcttccagacatgggagtacagttccgactttgctcttcggtcatatttgtaccttttctttcatgctcttggagctgggnctgcttcattgatctttggngagcataaggttcgtgtgttctactcagtgagaatctttcttggtctcatttcactattaccgaactggttctggtttgtgctctttcaagagatatgggaagcgcttngcttggtatggtcttgcaatgtagnnttaatcagcggntgcttctgggctagnacagttttcttggcagttcattctcca

SEQ ID NO: 35754 - protein, 183 aa, Zea mays
  misc_feature: Ceres CLONE 1416121-F
  misc_feature (114)..(114): Xaa is any aa, unknown, or other
  misc_feature (157)..(157): Xaa is any aa, unknown, or other
  misc_feature (165)..(165): Xaa is any aa, unknown, or other
  misc_feature (174)..(174): Xaa is any aa, unknown, or other
MSLSSARQRRATAASPPTDDGYAKDAKDRRRRPGGDGDSEDEGIKWFLPFLALGLLRHMSASSNLIHDCDEVFNYWEPLHFLLYRSGFQTWEYSSDFALRSYLYLFFHALGAGXASLIFGEHKVRVFYSVRIFLGLISLLPNWFWFVLFQEIWEALXLVWSCNVXLISGCFWAXTVFLAVHSP

SEQ ID NO: 35755 - DNA, 693 bp, Zea mays
  misc_feature: Ceres CLONE 1416129-F
aagctggagctcaccgcggtggcggccgctctataactagaggatcccccgggctgcaggaattcgcacgagaccattacctaaaacatcctaatcgaaaagtgctagtgctcagtcctcgccctctcgctttccgagggagcctttgccattcccctccgaccgccagacattagtggaggaggaatctccatccactcccccctcgcccccctcccactgctgctacttctagaagcgctggtggcagggcaggcgttatcccggacgctggcgctggtgcgagagttggatggaggtggagtccagcccccctccctcttcaggattagggtggagcgatccgtgcaggccaacgcggagtgcgtgacccaaaaagggaacccgccgccttttttctcttatgacgacccgcatttcacatccctcctcatcctcatccgccacgcccgcaacataagcaaaaaggtcatcgcctatttattgcccatctggtctgaacctgcatgtcatatgatcgtgctcccccaccccctttctgattcagccaggattccttccgcggcgcggcgcgtcgaaatgggcaactgctggggcgacaagatcagctccgacagaccctcccgcgccgaatccttcccgtcagggacggcgcaaaagatggtgagcacgaatggccgcgttgaagacccc

SEQ ID NO: 35756 - DNA, 720 bp, Zea mays
  misc_feature: Ceres CLONE 1416136-F
  misc_feature (278)..(278): n is a, c, t, g, unknown, or other
  misc_feature (279)..(279): n is a, c, t, g, unknown, or other
  misc_feature (515)..(515): n is a, c, t, g, unknown, or other
  misc_feature (538)..(538): n is a, c, t, g, unknown, or other
  misc_feature (594)..(594): n is a, c, t, g, unknown, or other
  misc_feature (652)..(652): n is a, c, t, g, unknown, or other
  misc_feature (690)..(690): n is a, c, t, g, unknown, or other
aaagctggagctccccgcggtggcggccgctctagaactagtggatcccccgggctgcaggaattcgcacgagaccattacctagaacatcctaatcgaaaagagctcaaacacacatcaagaaagcaagaaagaaaagactgtagctagctagccaccgcgcgcgcgcacgagtagtctagctagaatacactcgcgttcaaacaaacacacagcgtcgtgctgcgtgatctctgaccgcgtcgacaactaccgcagcaccaagcagctgatggcgnncaccgtatcttcctgcctgagcctcgtccccaccgtgcaccaccgggccggcgggttccccagcagtgtggcactgacgaacacgcttcagcgccgtcgtcgttctcgccgctatcttggcctcgcctcggcgacgagagccgaacaggaggtcgcccctgtgacgatcgaggacgtggacctcagctctcatcagggcgcggccgacgacggggagctcgccgcgcggtggcggnaggtcccggcagaacaaactggnagggtctgctggaccccatcgacggcgtgctcctccaggagctcatccgctacggngagttcgcccagccacctacgacagtttcgagtacgaccgctcctccccctactgcgnaagttgcaagtaccccgggaaaacttttttcacgacgntcggctcggggaattttggttacgaggccc

SEQ ID NO: 35757 - DNA, 699 bp, Zea mays
  misc_feature: Ceres CLONE 1416139-F
  misc_feature: Encodes the peptide sequence at SEQ ID NO. 35758
  misc_feature (273)..(273): n is a, c, t, g, unknown, or other
  misc_feature (312)..(312): n is a, c, t, g, unknown, or other
  misc_feature (364)..(364): n is a, c, t, g, unknown, or other
  misc_feature (370)..(370): n is a, c, t, g, unknown, or other
  misc_feature (373)..(373): n is a, c, t, g, unknown, or other
  misc_feature (376)..(376): n is a, c, t, g, unknown, or other
aagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcgtctgctgctacggaggtgcctctcgccgcggacttccgcttcgacccaccgacgaggagctcgtctcctactacctccgccngcgcgtactcggacgccgtctccgcgtcgacgtcatcgncgagatcgacctctaccgcctcgagccctggggactcccctccctctcccgnatccgnagncgngacgcccagtggtacttcttcgcccgtctcgaccgaaaggtcgccggagatgtcgacggggcccggggcggtcccgaaaacaggaccaaccgcgctaccccgagggggtactggaaagacacgggcaaggagctgcgagtgcaccaccgcggcaagcccgtcgggatgaatacgacgctcgtcttcacgcccggagggccccctaagggaaagaggaccaactggcccatgcacgagtaccgcctcctcgatgtagacggacctcagggatttgggtgggtttttttaaaaacttccacaaaagatgggcttggaacacagaa

SEQ ID NO: 35758 - protein, 52 aa, Zea mays
  misc_feature: Ceres CLONE 1416139-F
MNTTLVFTPGGPPKGKRTNWPMHEYRLLDVDGPQGFGWVFLKTSTKDGLGTQ

SEQ ID NO: 35759 - DNA, 633 bp, Zea mays
  misc_feature: Ceres CLONE 1416160-F
  misc_feature: Encodes the peptide sequence at SEQ ID NO. 35760
aaagctggagctccccgcggtggcggccgctctagaactagtggatcccccgggctgcaggaattcgcacgagaccattacctagaacatcctaatcgaaaacccggttttctagggtttaaagagcttgccgagcccgccgtgcgccggccggcacatctccactactttccgccatcgccggagccgaccccttcgtctccgcacgcggcaatggcattctccttcgcctcgccggctgcgtcgaaccctttccagacgccggcgacgccgaatccctttcaaacaccggctccggccacctcgcaggcgccatccctatcgccttcgccgttccagttcagcttccagcagcagccgcagccacagcagcaggtggcgccggcggcgcaacctccgcagccgcagccgcagccgcagccgcagaagctgatgctgtacacgacagatatgaaatctgcgggatacagcaccaagtgggaggagctgcacgccgagtcgcagaaggccttactccagatcgaggacaagatacggggactaacaaagaacgagtggtgagaggtttggacccaaggccagcccccccttttaggaacccccccaacccccaaaagggggcattttttgggg

SEQ ID NO: 35760 - protein, 115 aa, Zea mays
  misc_feature: Ceres CLONE 1416160-F
MAFSFASPAASNPFQTPATPNPFQTPAPATSQAPSLSPSPFQFSFQQQPQPQQQVAPAAQPPQPQPQPQPQKLMLYTTDMKSAGYSTKWEELHAESQKALLQIEDKIRGLTKNEW

SEQ ID NO: 35761 - DNA, 661 bp, Zea mays
  misc_feature: Ceres CLONE 1416161-F
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcaaaaattgtagagcagtgcgacagagttccccgatcgaagcagattgaggtccactgtgctgtactgctgtgcgtcaatcatggaagcaatccaccttgcctacgtgctcgtcttcctcttgcccatcctcctcctccgtctccggcgccgcgggcctcctccagtcaagcggccacgaacaacgacggcccactgcccgcaccccagcccggtcctgggcaacaccctccacttcatccgcaaccgccgccgcttcttcgactggtacgcggacatgctccgcgccgcgccgtccggtgcatcgaaggggcgtgggggcccctttgggcgcgggccacgccgtcaccaccgccagcccggccgacgtcgaccacctcctgcgctccagcttcgacaagtacgccaagggcgcgctcttccgcgacgccaccgcggatctcatcggcgacgggctctccgccgccgacggccgcctctggacctccaagcggaagctggcgtcgcacgccttctcgtccgctcgcttccgcggttcaccgacggnggtcctcgacgtgcacctt

SEQ ID NO: 35762 - DNA, 678 bp, Zea mays
  misc_feature: Ceres CLONE 1416163-F
  misc_feature: Encodes the peptide sequence at SEQ ID NO. 35763
aaagctggagctccccgcggtggcggccgctctagaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatgcctcctccgtctccgccgccgccaaggccgccgcggcgttcgcgcacaaggtccagaaggagctggccgcgccggcgcagcgccgcgcgggcttgacccgccggaccaagccgtgcagcgtgcgcgccgtcgcttcgcccgcgcgcgccctgtcgtccaccggctcggtgaagagcgcgatgacgatgacggagaagatactggcgcgggcgtcggagcgcgcggcgctggagccccgggagaacgtgtgggccgacgtcgacgtgctcatgacgcacgacgtctgcgggcccggcgccttcgacatctttcagaaggagttcggggaggacgccagggtctgggaccgcgagaagctcgtcgtcatcccgaacactacatcttcacaggggacgggcgtgcaaaacgcacgcgacattctcgggggactttggtggggaga

SEQ ID NO: 35763 - protein, 87 aa, Zea mays
  misc_feature: Ceres CLONE 1416163-F
  misc_feature: SWISSPROT Homolog: EC 4.2.1.33 3-isopropylmalate dehydratase
MTMTEKILARASERAALEPRENVWADVDVLMTHDVCGPGAFDIFQKEFGEDARVWDREKLVVIPNTTSSQGTGVQNARDILGGLWWG

SEQ ID NO: 35764 - DNA, 854 bp, Zea mays
  misc_feature: Ceres CLONE 1416269-F
  misc_feature: Encodes the peptide sequence at SEQ ID NO. 35765
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (32)..(32): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttttttccccccnnnnnnnnnnntnaaggtcnatttntacagggnnnnnaaaaagtggagctccccgcggtggcggccgctctagactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccggggccgaggtagtcgtgaccgaatctgcgccggcggaggcggagggtgcctgccgggacggatgctgaaacccgaggcaaggatgagaagaaaggtgacgagggggagctcaccgcccgatgacgcggggggggtggacccggttccgtcaaaggaggaacagccaccttggggggaaagacctggcccgaaccccgaaaaaaaaagggcgctccgaacaagggttcaaggcaagtttgatccgctgtgcttgccccctcccccggcccgggttaaattttcaaattttgggccttcccccccggccctgtcgggtccggcccgaaaagggcccaagggggaaacacaaaaggggggggaggggaaagcccaaaggggccccaaagtagggattggggggattgcccccccgggtttgaaggaagggcgcagaaaaagggaagggggccgcgccgggccccaggggggggcccaagggctgaagaacctctgggcgtggaggaaaacgccaaggcctttcccgagccccgaaacccgaaaggaaaaaaaaacggggcggggtcctcttggaaggagggtcactggcccc

SEQ ID NO: 35765 - protein, 38 aa, Zea mays
  misc_feature: Ceres CLONE 1416269-F
MAEETQPEAAAAAAPAGAEVVVTESAPAEAEGACRDGC

SEQ ID NO: 35766 - DNA, 682 bp, Zea mays
  misc_feature: Ceres CLONE 1416272-F
  misc_feature: Translation starting site: 500
  misc_feature: SWISSPROT Homolog: EC 2.3.1.92 Sinapoylglucose--malate O-sinapoyltransferase
  misc_feature (234)..(234): n is a, c, t, g, unknown, or other
  misc_feature (247)..(247): n is a, c, t, g, unknown, or other
  misc_feature (252)..(252): n is a, c, t, g, unknown, or other
  misc_feature (276)..(276): n is a, c, t, g, unknown, or other
  misc_feature (282)..(282): n is a, c, t, g, unknown, or other
  misc_feature (286)..(286): n is a, c, t, g, unknown, or other
  misc_feature (332)..(332): n is a, c, t, g, unknown, or other
  misc_feature (346)..(346): n is a, c, t, g, unknown, or other
  misc_feature (356)..(356): n is a, c, t, g, unknown, or other
  misc_feature (396)..(396): n is a, c, t, g, unknown, or other
  misc_feature (400)..(400): n is a, c, t, g, unknown, or other
  misc_feature (526)..(526): n is a, c, t, g, unknown, or other
  misc_feature (593)..(593): n is a, c, t, g, unknown, or other
ggagctccccgcggtggcggccgctctagaatagtggatcccccgggctgcaggaattcgcacgagaccattacctagaacatcctaatcgaaaagaggatgccttgccgcctctgctgcttcctgctcgtcgtcgccgcctccgccgtctccgggcgggggcgggtggtcaccaccctcccgggctacgagggccgcctcccccttccactcgaaacaggtatgtggaggtgnacgaggacgccgncgcgnagctcttctactacttcgtccggnccgagntcgncgccgacgacagcgacaccccgttcgtcctccggatccccggcggncaacgctgctccgncttcagcggnctcgcctacgagataggtcccatcatttgtcgtggagccntacnacggcagcttggcgcgcctgcgctacaacccaactcgtggacaaggtggcgcatattctttttgtgattcgcagtgggggccgggttttcttctcagagatgccaaaggctacacgctggagcggnatcaacacgctgcactggccgaattcttcaacaggtgttcaacgaccatctggagaccatgcaaatntttctacatcgagggaaaacatacgctggaaaaatgaaccattccttgcaagaggattcaaaaggattggacaggaatgaatcccaccc

SEQ ID NO: 35767 - DNA, 711 bp, Zea mays
  misc_feature: Ceres CLONE 1416274-R
  misc_feature: Pfam Name: Cu-oxidase_2 Pfam Description: Multicopper oxidase
acgattgggtaccgggccccccctcgaggtcgacggtatcgatattctttttttttttttttggagagctcttggagatgctcttagccagttgaagaacaggactacatgaggtgcgatacaaaacgctaagatcggaatcatcaacaaaaggaatgaactaatcagagaaaaaccatggacccttcctaacagaggctaacacacgcacacaatgaaagcgagggagaactgtaccaggcggaggccagcactgctggcatatgaacaattctcataggtaatgacgcggcctacgcctctaatcctaatcaaacatacataaacgggtgccgcctcggtgcagaagtaacggttgccatcactcactctacggcgcgaatacgaaggatccggcgaggagcagcgccgtcgcgagcagccagcgcgctagtgacaccaacgagcgtggcgccgcagcagacgcccccatcttgtggtgcggagtctgctccttctggtacttgtggagctggccgcagtagagagcgttggcggggatggccatctcggtcttgttgccggtgtcctcagggttgacgaccctgacgtagacctcctgccccaggtaccacgagtccaggttctgggaccgcacgttccagacgccgacgttgtcaagggacaccagcaccgccgcccacgcgcccgggtacacctgtatcgtgctgc

SEQ ID NO: 35768 - DNA, 676 bp, Zea mays
  misc_feature: Ceres CLONE 1416278-F
  misc_feature: Encodes the peptide sequence at SEQ ID NO. 35769
tggagctccccgcggtggcggccgctctagaactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaaaagcggcggcggcggaggaggaggaggctggcggcatgctactcatcgagacctgctgccggcgccgctcaaggccagtgtcagtgcggctcctctagccccggtggcggcggcggaagcggcagcctcgtggcaagacaccgcgcgcgttctcgagctgctccagctacgccgcctcgtctgcctgcgcgccggcggcggccgtccatcctcggacccagcacaagctgacggggctcctcgtcgcgctcgcgctcctcctcgtcctccctcgccctcctctctcaggggtcccggtggtgtcgccccgcagaatggcgaggatccccagccacgtggagaggataaacaagacccccgtgggctccattgagagccaggaaggggacaccatccaatgggtggcggcgcaacaagaagaacggcctggaccacccgcttcctcgggggcacggcgtcca

SEQ ID NO: 35769 - protein, 49 aa, Zea mays
  misc_feature: Ceres CLONE 1416278-F
MARIPSHVERINKTPVGSIESQEGDTIQWVAAQQEERPGPPASSGARRP

SEQ ID NO: 35770 - DNA, 689 bp, Zea mays
  misc_feature: Ceres CLONE 1416283-F
  misc_feature: Encodes the peptide sequence at SEQ ID NO. 35771
  misc_feature (476)..(476): n is a, c, t, g, unknown, or other
  misc_feature (501)..(501): n is a, c, t, g, unknown, or other
  misc_feature (547)..(547): n is a, c, t, g, unknown, or other
  misc_feature (550)..(550): n is a, c, t, g, unknown, or other
  misc_feature (561)..(561): n is a, c, t, g, unknown, or other
  misc_feature (562)..(562): n is a, c, t, g, unknown, or other
  misc_feature (564)..(564): n is a, c, t, g, unknown, or other
aagctggagctccccgcggtggcggccgctctagaactagtggatcccccgggctgcaggaattcgcacgagaccattacctagaacatcctaatcgaaaaaactcgccgtctcgccagtcgccaccatctaaagccgcggctccaatcccaccgcaggacaggcaggcagagcgcgccccgcgccatttcagccatgtcgacgacgtcgtcgtcgtcgtcgtcgtcgtcgtcgtcgtcgttccagtggcgcccatgggtggcactctcctccatccccgtcgtcgtcggcgccaacaacgagcgggcacggaggctcgcgcccggtgcctccgacctctttctcgacatccagctcccacagcacggcgcctcctacctgttcctgcccgagcgcatcataccggagcccaggaattcgtattcaggccgccaccccttcaccatcctgtccgcctgctccgaccgcttctcttncattgcgggttgggggtacccgagnccgagggcgtctcgaaccccgcctgcttcctcggcacgcccagccnagnacccgcgtcgnncntccccgacgtcccgcccccacctcggggtcaacatcatactgcgaaacagcattggcctcatcgcgacccggggacacggtggccatttacatgggtagccagctccaccccacctggcagaccc

SEQ ID NO: 35771 - protein, 155 aa, Zea mays
  misc_feature: Ceres CLONE 1416283-F
  misc_feature (94)..(94): Xaa is any aa, unknown, or other
  misc_feature (102)..(102): Xaa is any aa, unknown, or other
  misc_feature (118)..(118): Xaa is any aa, unknown, or other
  misc_feature (119)..(119): Xaa is any aa, unknown, or other
  misc_feature (123)..(123): Xaa is any aa, unknown, or other
MSTTSSSSSSSSSSSFQWRPWVALSSIPVVVGANNERARRLAPGASDLFLDIQLPQHGASYLFLPERIIPEPRNSYSGRHPFTILSACSDRFSXIAGWGYPXPRASRTPPASSARPAXXPRRXSPTSRPHLGVNIILRNSIGLIATRGHGGHLHG

SEQ ID NO: 35772 - DNA, 669 bp, Zea mays
  misc_feature: Ceres CLONE 1416291-F
  misc_feature: Encodes the peptide sequence at SEQ ID NO. 35773
  misc_feature (392)..(392): n is a, c, t, g, unknown, or other
  misc_feature (403)..(403): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (600)..(600): n is a, c, t, g, unknown, or other
  misc_feature (643)..(643): n is a, c, t, g, unknown, or other
aagctggagctccccgcggtggcggccgctctagaactagtggatcccccgggctgcaggaattcgcacgagaccattacctagaacatcctaatcgaaaaattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgcggcgggcagggctgcagcagcagccggcagcgcgtgcatcttgcgaccccctttccnagaacagctgncagctttggccttttccgcctgggcgtaccgaaatnnncgcagaactcacccaagaaaaagcggcgcccttttggctggctggctgccattccctcacgcccacgagtttggtggagctttgaaacgagcacagttcacaagacagtgaggctggcggtgggtgtttcctcgtcggagatggagggaaatttgcccngcgcaacatggtcccaggcggaggccccttcgatctggggcangcgttccactttcgcgtccaccccag

SEQ ID NO: 35773 - protein, 73 aa, Zea mays; identical to SEQ ID NO: 28423
  misc_feature: Ceres CLONE 1416291-F

SEQ ID NO: 35774 - DNA, 618 bp, Zea mays
  misc_feature: Ceres CLONE 1416299-F
  misc_feature: Encodes the peptide sequence at SEQ ID NO. 35775
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaagtgaaagcacacggatcatgcttgttgacaggatgacaaacaatctgtctacagagtccattttctctcgcaaatatcgcctttttggaaagcaagaggctcatgagaatgcaaaaacgattggagaactttgcttttgccttgcgtggatgagcatttcagagaggagccagatgggtgatgggaagttctgctggcccagctatatn

SEQ ID NO: 35775 - protein, 88 aa, Zea mays
  misc_feature: Ceres CLONE 1416299-F
MDSAQDFQPRTFSIKLWPPSESTRIMLVDRMTNNLSTESIFSRKYRLFGKQEAHENAKTIGELCFCLAWMSISERSQMGDGKFCWPSY

SEQ ID NO: 35776 - DNA, 642 bp, Zea mays
  misc_feature: Ceres CLONE 1416301-F
  misc_feature: Encodes the peptide sequence at SEQ ID NO. 35777
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaacaagacgagatctacccgctgccccctcgcattcccctcccccgcgtcgtcatctccccaaatccccccaaaccctaccgccgatccggccccagatcgccatggccgcgcccaacagcaatgacgccgccagcgccagcggcaccggcccggctggcgaggaggacatctccatcgaggcgttggcgcggcgcgtgcaagagcacatgaccctcaactcgaaccccgccgctcgccgccacaagttctgggagacacagcccgtcggccagttccgcgacgccgccgacgcatcgctaccgaacggccccatcgagccgcccacgccactctccgaggtgcgcgccgacccctacccactgcccgccgccttcgagtggctcacctgcgacctcgatgacgacgcgctcctcgccgacctctactcgttgctcgcccacaactacgtcgaggatgacgagaacatgttccgcttcaactactccccggctttcctccgctgggcgntcaaagccgccgtccttcttccgggctgggaa

SEQ ID NO: 35777 - protein, 146 aa, Zea mays
  misc_feature: Ceres CLONE 1416301-F
  misc_feature (68)..(146): Pfam Name: NMT Pfam Description: Myristoyl-CoA:protein N-myristoyltransferase, N-terminal domain
  misc_feature: SWISSPROT Homolog: EC 2.3.1.97 Glycylpeptide N-tetradecanoyltransferase
  misc_feature (136)..(136): Xaa is any aa, unknown, or other
MAAPNSNDAASASGTGPAGEEDISIEALARRVQEHMTLNSNPAARRHKFWETQPVGQFRDAADASLPNGPIEPPTPLSEVRADPYPLPAAFEWLTCDLDDDALLADLYSLLAHNYVEDDENMFRFNYSPAFLRWAXKAAVLLPGWE

SEQ ID NO: 35778 - DNA, 707 bp, Zea mays
  misc_feature: Ceres CLONE 1416302-F
  misc_feature: Encodes the peptide sequence at SEQ ID NO. 35779
caagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatgggggatggacgccggcggcggcaagctgccgtacagctacgccggccagcaggacggcgggaagctggtgaagagcgtcagccgcgtgaagccgcgcaagttcggcctgggccctcggggtgggtttccctcggcggcaccctgcggctacttctcccacggccaaggttcgacgccattccaagatcggccttgaaccagccgaaccggctccagaaaaggcgggctggggcgtcccgagacccctttccgcttggggagagggttcggcaggctgtccgccgcagcactttccaatgacctccaggcaccgcgtatttaaatatttggggcgcggaagggtccaagggcccc

SEQ ID NO: 35779 - protein, 63 aa, Zea mays
  misc_feature: Ceres CLONE 1416302-F
MDAGGGKLPYSYAGQQDGGKLVKSVSRVKPRKFGLGPRGGFPSAAPCGYFSHGQGSTPFQDRP

SEQ ID NO: 35780 - DNA, 674 bp, Zea mays
  misc_feature: Ceres CLONE 1416320-F
  misc_feature: Translation starting site: 281
  misc_feature (446)..(446): n is a, c, t, g, unknown, or other
aaagctggagctccccgcggtggcggccgctctagaactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattggtagatacgtactcgggtggagcagaacaacgagagacatggcgacgacgacgcgtgttgccgccaccgccgccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcnacggcgagttccccggccccaggatcaactgctcctccaacacaacatcgtcgtcaatggtcttcaccagctcgaccatccgctcctttttcactgggaacgggatgcagcacaggaagaactcgtggattggacgggatgccaggcacggcagtgtccgatcctggctaacaccacttcacgtacaagtggcagccaagggaccagatcggcagcttcttctactcc

SEQ ID NO: 35781 - DNA, 726 bp, Zea mays
  misc_feature: Ceres CLONE 1416326-F
  misc_feature: Encodes the peptide sequence at SEQ ID NO. 35782
aaagctggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgcctgccgcggcgctggctgccatggggtggcgtccgggctccaagaccggtgtcgacggcctcccgccggggcctccgggtggccggtggtggggaacctgttcaggggatcctgcagcgactgcgctttatgtacgtggtgcgcgcacctccgggagaggtaccggccccatcttcaccatgcggatggggcagcgcaccctcatcgggggcacctcgggggagctcatccacgaagcgctggtgaagcagggccccatgttcgcgagccggcccgaggacacccccccccgccttctcttcagggtgggaaagggcaccgtaaattcggggccctaggcccccctgggggggtgttttggcccaaaaattcttcgccaaaaattgtgtccccgcacgccggaaaggggtttcttctggaatccgggaggggggccggggaaccccaaatttggccccgcctcccgcg

SEQ ID NO: 35782 - protein, 122 aa, Zea mays
  misc_feature: Ceres CLONE 1416326-F
MDVNDVLLVVPAAALAAMGWRPGSKTGVDGLPPGPPGGRWWGTCSGDPAATALYVRGARTSGRGTGPIFTMRMGQRTLIGGTSGELIHEALVKQGPMFASRPEDTPPRLLFRVGKGTVNSGP

SEQ ID NO: 35783 - DNA, 689 bp, Zea mays
  misc_feature: Ceres CLONE 1416341-F
  misc_feature: Translation starting site: 299
aaagctggagctccccgcggtggcggccgctctagaactagtggatcccccgggctgcaggaattcgcacgagaccattacctagaacatcctaatcgaaaagacgttccggagaccggaaacacatactctccagtctcactcgcgcactctcgcaagctataattccaaggcaccgccgccgcatcgatctcgggaatcgaaactcgaaaggcgcacgcggtccacgcccccggctcgcccagctcgagaagccacctgcactcctcccttctagaagcttccatttccttaggccatggaagacgactacgacttcccggcggctggcgggtacgaccccatgggaatgatggggatggggatgggaggctacggcctcggtggccccatggggatggggggctacggcctcggaggtcccatggggatggggggctacggcctacgcggtgaggacgacgacgatgccatgaaggacctacacgtcggcgccggagcaggggcaggggacgatcctcccgcggagatgaaggtgcgagaggagagagagatcgggaaggaaaggctgaagcaaaagctggtgaaggagggtaagggatgtgaccggccccggggccggggacgaaatcgaaggtccactacccgggggcaggtggaaagacggaacccatggtccaatcccaccg

SEQ ID NO: 35784 - DNA, 697 bp, Zea mays
  misc_feature: Ceres CLONE 1416349-F
  misc_feature: Translation starting site: 390
  misc_feature (621)..(621): n is a, c, t, g, unknown, or other
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagccccgctcgctccccgtcatcgtcacctacaggnccgaattgggagggaggccagtacgcaggcgaagatgagccacggtttgaggcgcttctactggcaatggagctgg

SEQ ID NO: 35785 - DNA, 711 bp, Zea mays
  misc_feature: Ceres CLONE 1416350-F
aagctggagctcaccgcggtggcggccgctctagaatagtggatcccccgggctgcaggaattcgcacgagaccattacctagaacatcctaatcgaaaaacggcccaccccgatctcataatcgtcgtcttctcccacttcgacgcggctaggggcggcgctaccatctcctcttctcttccggcggcttctcccgtccgtcgatcaaccgcgccccgcttcgcagtataccccgcattgagccgtcatcgttacctgggcgcgacgggcactctgtagcctcttctcccaggggtgcacgaggaggaggaagttcgggcttcgccatgtcgaagtcgaacctagatgatctgcttctgcaggcagccggcccgaacggggaaaacccactccccgggcgagcaacccggcggtggaactctgggggaaagcggctcccacggtttcaacgacgacgacttcggacgccgcgccgacttactggaggaagaagcccttcgtcgaaggttcggctcaagaaagggcaccaacccaaaacagggggggcccgcggttccaattggccggtgtgaaaggaccaagaccaacgaggaccaaaaaaggccgtcccaagtggggggaaaagaattcgaaaagggccccctttgggggggggagggtgccttaaccaaggggtgggggcccaaccgggggggggtttggaaaaaact

SEQ ID NO: 35786 - DNA, 615 bp, Zea mays
  misc_feature: Ceres CLONE 1416454-F
  misc_feature: Encodes the peptide sequence at SEQ ID NO. 35787
  misc_feature (106)..(106): n is a, c, t, g, unknown, or other
  misc_feature (332)..(332): n is a, c, t, g, unknown, or other
tggagctccccgcggtggcggccgctctagaactagtggatcccccgggctgcaggaattcgcacgagaccattacctagaacatcctaatcgaaaaaacgcctcncaccacgaggcacgcaacaattagaacacatcttgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatcccccgattctcctccgccgccgnccgcggatcccttccctgaagccttctcctccccgaccaggctctcaggatgcgctgaggccggaaaggacacctgagctcgaggggggaggaagctggcgaacccaacaacatctttgcctcccccgggaggcccaaacccgaaacccaaaaatgagggaggtcgccccgaatttggccccgcctggagagcccccccccgaggaagaaaaccccccccccccccccttgacattaaccgggggatttcaaaggggcctccccctagcccggagcccccccg

SEQ ID NO: 35787 - protein, 62 aa, Zea mays
  misc_feature: Ceres CLONE 1416454-F
  misc_feature (57)..(57): Xaa is any aa, unknown, or other
MMWRSRARALLLLRSTITRPPPPPPQPYPTRTLTRVPPPRFLSSSPDPIPRFSSAAXRGSLP

SEQ ID NO: 35788 - DNA, 648 bp, Zea mays
  misc_feature: Ceres CLONE 1416463-F
  misc_feature (73)..(73): n is a, c, t, g, unknown, or other
  misc_feature (74)..(74): n is a, c, t, g, unknown, or other
  misc_feature (77)..(77): n is a, c, t, g, unknown, or other
  misc_feature (233)..(233): n is a, c, t, g, unknown, or other
aaagctggaggtctccgcggggtggggcgcgctctaaaataggggatcccccgggctgcaggaattcgcacgnnggngattattccctaaataattctaatagaaaagagccccatattccctttttacaacggacccgtcccgtcccactgggtgggagagggtgtcccccgttctctctcttcaagagatatcgcgctctcgggatcaggggcggcgggggggggagggcncaaagagccttgccaacccccgatgctcttctcgaagaggattaaattacgtgggcccgatgttcgccttcgccgccatcctgctgctcctcctctctggggatattagaggtcccttcaatttccaccccggggcgcgtcttcgggggggggggggggggttccccccccgctcgattccctcggtgggggggggggaccccttcccctcctcctctaggaattccttccggggagggcaccccccgtttgccccccctttgtgaaaaaattcccccccgggggggggggggggcccccccgcccctccctctctaagggaaaacccccccccccccttttataaaccccccggggaaacttcggggggggggttcacaaaaaagggggcccccgggggggggggaaaaaaaaa

SEQ ID NO: 35789 - DNA, 696 bp, Zea mays
  misc_feature: Ceres CLONE 1416465-F
  misc_feature: Encodes the peptide sequence at SEQ ID NO. 35790
  misc_feature (332)..(332): n is a, c, t, g, unknown, or other
  misc_feature (373)..(373): n is a, c, t, g, unknown, or other
  misc_feature (418)..(418): n is a, c, t, g, unknown, or other
  misc_feature (480)..(480): n is a, c, t, g, unknown, or other
  misc_feature (489)..(489): n is a, c, t, g, unknown, or other
  misc_feature (492)..(492): n is a, c, t, g, unknown, or other
  misc_feature (521)..(521): n is a, c, t, g, unknown, or other
  misc_feature (528)..(528): n is a, c, t, g, unknown, or other
  misc_feature (583)..(583): n is a, c, t, g, unknown, or other
  misc_feature (594)..(594): n is a, c, t, g, unknown, or other
  misc_feature (608)..(608): n is a, c, t, g, unknown, or other
  misc_feature (609)..(609): n is a, c, t, g, unknown, or other
tggagctccccgcggtggcggccgctctagaactagtggatcccccgggctgcaggaattcgcacgagaccattacctagaacatcctaatctaaaaaaaaaaccctacccgactccgccgccgcccgccgctccgcctcagcgcatagcccgccgcgacctcatcgatcaccttcaactttcaatcatggcggacgtcgatgtcgaaccggaggttgccgccggagctcccaagaagaggacgttccgcaagtacagctaccgcggcgtcgacctagatgcgcttctcgacatgtccacggacgacctcgtccagctcttccccgcgcgcngcaggagaaggttccagaggggtctgaagagaagcccatgncgctcatcaagaagctgcgcaaggcgaaaaagatgctcctgctgntgagaaaccagagcagtcaagacacatctccgtaacatgatcattgtccctgagatgattgnaagcattgntgntgtctacaacggcaagaccttcacccagntgagatncagcctggagatgatcgccactaccttgctgagttctccatctcctaatagccgntcaagcatggncagccgggtatcgnngccacccactcctcggcgttattcctctggaatgaggctgtaccccgttctgcagtctccaagagtcagtggcaatggtcgtcagct

SEQ ID NO: 35790 - protein, 76 aa, Zea mays
  misc_feature: Ceres CLONE 1416465-F
  misc_feature (49)..(49): Xaa is any aa, unknown, or other
  misc_feature (62)..(62): Xaa is any aa, unknown, or other
MADVDVEPEVAAGAPKKRTFRKYSYRGVDLDALLDMSTDDLVQLFPARXRRRFQRGLKRSPXRSSRSCARRKRCSC

SEQ ID NO: 35791 - DNA, 692 bp, Zea mays
  misc_feature: Ceres CLONE 1416472-F
  misc_feature (379)..(379): n is a, c, t, g, unknown, or other
  misc_feature (492)..(492): n is a, c, t, g, unknown, or other
  misc_feature (532)..(532): n is a, c, t, g, unknown, or other
  misc_feature (542)..(542): n is a, c, t, g, unknown, or other
  misc_feature (580)..(580): n is a, c, t, g, unknown, or other
  misc_feature (590)..(590): n is a, c, t, g, unknown, or other
  misc_feature (597)..(597): n is a, c, t, g, unknown, or other
  misc_feature (607)..(607): n is a, c, t, g, unknown, or other
  misc_feature (638)..(638): n is a, c, t, g, unknown, or other
  misc_feature (658)..(658): n is a, c, t, g, unknown, or other
  misc_feature (659)..(659): n is a, c, t, g, unknown, or other
tggagctccccgcggtggcggccgctctagaactagtggatcccccgggctgcaggaattcgcacgagaccattacctagaacatcctaatcgaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaaagttaagatctgttccacagatcacgcgtgccgctcgcgaaatcgggggtccacacatagcttcgtcgttttgaatttgatgtactaatggagtctaagggtgncaagaagtctagcagtagtcgttccatgatgtatgaagctccccttggctacagcattgagggacgtcgacctgcccggagcgcgaagaaagtccagtctgctgcttactccnactgcgcaaagaagccatcctgatatcccttttggctccntcgttctagnagttaagggatttctttctgacacttcgattcttaccnatcccctggnctgctgncttcctgacnatcgaccagttccccagtctgctcctgcagncctccctcctcatctccagnngtgtgttctgactcactgcaccagtggctgtct

SEQ ID NO: 35792 - DNA, 683 bp, Zea mays
  misc_feature: Ceres CLONE 1416513-F
  misc_feature: Encodes the peptide sequence at SEQ ID NO. 35793
  misc_feature (627)..(627): n is a, c, t, g, unknown, or other
  misc_feature (683)..(683): n is a, c, t, g, unknown, or other
aaagctggagctcaccgcggtggcggccgctctagaactagtggatcccccgggctgcaggaattcgcacgagaccattacctagaacatcctaatcaaaaaaaatctggaatcctttcacgccgccactctcccctttttccttctctcttcgtcgatgtggctcctgccttcctgcctcggtgcatcgactcgcgtagagggacagcacagcgcctcctccccatcctttctccattcccagatcgaaggaccataaaaaaccatccttttgcatctgattgagcactgtctttgtgcaagagaacaatttagatgtacatacaaacaaaaagaagtgggagtatttttcagagtttattagaagagactgtttcgaggacccaggtcagagaaaggcgagaagctttagcagcggtaatggtctggtcaatggacccgtaggtgaccgtccacggagactgggtgtcagacgtggtgccgctgatgaagctgctgtgcctggcggtgatcggcctgctcctcgccaagccgcgagatcaggtcgtgcccagagacagcttcaagctcctgagcaagctcgtcttcgcgctcttcctcctctggctcatcttcgtccacctcggncatgtcgtcaccatagacgacgtcctgcactggagggtcatccccgtcaacgtgcn

SEQ ID NO: 35793 - protein, 65 aa, Zea mays
  misc_feature: Ceres CLONE 1416513-F
MKLLCLAVIGLLLAKPRDQVVPRDSFKLLSKLVFALFLLWLIFVHLGHVVTIDDVLHWRVIPVNV

SEQ ID NO: 35794 - DNA, 660 bp, Zea mays
  misc_feature: Ceres CLONE 1416518-F
  misc_feature (415)..(415): n is a, c, t, g, unknown, or other
  misc_feature (531)..(531): n is a, c, t, g, unknown, or other
aagctggagctcaccgcggtggcggccgctctagaactagtggatcccccgggctgcaggaattcgcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggaatgatgcatggatcagacctaacctctatatcatcaccaaacgctcgtagatgatgctatacaattccatgattaaattatatataagtaaaaaaaaaagaaccgtacgtgcatacataaaattaagaattaatggctgccaaatggacgacatatgcatggacaggtaagcttnttgatcccactgaacccgggaagccgcccaaactcccggtccatgatccgggatgatcgaacgggaggacggacctgaaacccgcttgcaaccaagggggggcccaaaggaaccgnggcttgcaagggggggccgcttccccccgccgccgattcggggggggaaaaaaataatttgaacctgaaaaacggaaaccccggggggccccttgtggcaaaaaaaaaaacggaaaggggggtcccccc

SEQ ID NO: 35795 - DNA, 418 bp, Zea mays
  misc_feature: Ceres CLONE 1416520-F
  misc_feature (163)..(163): n is a, c, t, g, unknown, or other
  misc_feature (210)..(210): n is a, c, t, g, unknown, or other
  misc_feature (353)..(353): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
tggagctccccgcggtggcggccgctctagaactagtggatcccccgggctgcaggaattcgcacgagaccattacctagaacatcctaatcgaaaaactgccaactcgcacgcagcagtacgacgtctctcctctgggtctggggccgagacaccgagcacngtactaccagcaagatggtggcgtctcccagattcaagcccccatcngaggagtgctgctcggaaggggcggtcggagcagacggtggccgccgaccctgaaaggggaacggctggtttcatctcccaggaaggggggtttccccctactaaacctcccctccgggggggttcccccgaagggcccgggnaaagggggttttcccttccccccgggggcccccgggggggnnntttggggtggggggggcctccc

SEQ ID NO: 35796 - DNA, 679 bp, Zea mays
  misc_feature: Ceres CLONE 1416523-F
  misc_feature: Encodes the peptide sequence at SEQ ID NO. 35797
  misc_feature (486)..(486): n is a, c, t, g, unknown, or other
  misc_feature (520)..(520): n is a, c, t, g, unknown, or other
  misc_feature (526)..(526): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaccccgtccctccactcctcccgtcgagcacttggcactgccaatggcggcagccgcccacaccccttcgatgcgtgcaagccgcctcctttcctcctgagatcgacgcacctcctcctctcgtactccattcccgctccaagtttgtttcttcggcaccgagccatcgcacggccgcccccgcatctcgtcctgctctcaggtccttggcctccgccgttcttcgacaggggcgcgacccggtgcccactccgcgaaatccgagtccctcgtgcagctccgtagggtggaagagatccatcaggcggtgagcggtaggaggcgcccgtacaaactgagggggcggcaatggcggccgtggcaggccactctgcacgtggctcgntgccgcgtgcttgtctgcggcttgcgacgcaaangagtancagcataagcattgctgccccggcggaaagcgcgctgggggcggcgtcatggtcggccaggcgccgcgcctcggngcgcggggtcgccgcttggcgcgctctggaatggctatggctggtggcttaacagctgaaagaaagggcatggaaaaa

SEQ ID NO: 35797 - protein, 35 aa, Zea mays
  misc_feature: Ceres CLONE 1416523-F
MVGQAPRLGARGRRLARSGMAMAGGLTAERKGMEK

SEQ ID NO: 35798 - DNA, 686 bp, Zea mays
  misc_feature: Ceres CLONE 1416541-R
caattgggtaccgggccccccctcgaggtcgacggtatcgataagcttttttttttttttttttagaatgaacagttatatataaaaaaaatggggtgataccatcatacaaaacactgcatattattacaacagttaaataaaatatcctaaatcatggcgagtagctccctattattatattatatacacaattgcaccccaaggacagtgtcctcatttatttgatacagaaatttggaatactacaaccgtcccctaccaccctgttgcgctaagggtaaatgcagggagataaacataaatacatacatgcataaatattccatccgtacgtatacgaacttagatgggcctcttgtgtgatcacgacaacagcagcagagtctagtgattctcttcgtgttccttaactattgtgatgctgttatcaagtttgatgaccccctttacaagttatcatcatcaaatattgtcgagagcacaagccctcggacgaatttgctcctttgaacccttttcttctgatctttctccgataatgatggttcagcccccgctcttagcctcaacggcatgctcgtcgtcgatgtgacagcagaggccgacgaaatcgaagtcctcgccgcagaaggggcagttgtaggactccgccccgccgcgcgggtccgtcacctcgtccaagg

SEQ ID NO: 35799 - DNA, 809 bp, Zea mays
  misc_feature: Ceres CLONE 1416542-F
  misc_feature: Encodes the peptide sequence at SEQ ID NO. 35800
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
ggggggggnnnnnnnnnnggccccccccccccccccatcgctcanncnnnnnanntnnnnnntttcaattttccaaagctggagctccccgcggtggcggccgctctagaatagtggatcccccgggctgcaggaattcgcacgagaccattacctagaacatcctaatcgaaaaatgtaaaccacactccactccagcactgaacacttgattgattcagtaggtagctagctagctgaatcacaatggatcctaccaagttccgtccgtccagtagccacgacacgacggtgacgacgacgaacgctggcgctcctgtgtgggacgaccacgaggcgctgaactgtggggcctcgcggtcccatcctggtgggagactaaccacctgatcgagaagggggcgcactttccgcgcgggaacgcaatcccggaaacgcgtggttgcaccccgcccgggggcccccccgcccagggctttctttcaagggggcccccccaacgtggaacgctccttgaacggggggcccaaattttcctgggcgggggccccggggggggggggaacccccccgggaaaacgggcggctttttccccgagggggaaacccccaaaagggggggggccccccccggaaaaaaaaaccccgcgaacccccgggggggggttccccccccggggaggaatttttcaaccccccccggggggagaaaaaatggggacaccccgggggtgggaaaaaaaaaaatttccccccgtttttttttttttttcgggcgaggggggtttaaatttttccccccacagggg

SEQ ID NO: 35800 - protein, 47 aa, Zea mays
  misc_feature: Ceres CLONE 1416542-F
  misc_feature: SWISSPROT Homolog: EC 1.11.1.6 Catalase
MDPTKFRPSSSHDTTVTTTNAGAPVWDDHEALNCGASRSHPGGRLTT

SEQ ID NO: 35801 - DNA, 694 bp, Zea mays
  misc_feature: Ceres CLONE 1416543-F
  misc_feature: Encodes the peptide sequence at SEQ ID NO. 35802
aaagctggagctccccgcggtggcggccgctctagaactagtggatcccccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacaaagaagcagctgatgatccaagtagcagagctagttcccaagcatcacggaaggacaaagaagcaagagttcaatttgaggaaacctccatccttccactatgatttgcttctcttaggcttcctgacgttaatgtgtggccttattggtatccctccatcaaatggtgtcattccacaatcacccatgcacacgaagagtttggctactctcaagca

SEQ ID NO: 35802 - protein, 176 aa, Zea mays
  misc_feature: Ceres CLONE 1416543-F
  misc_feature (24)..(120): Pfam Name: SRP19 Pfam Description: SRP19 protein
MATSNTARMEDGGGDLRSTIKKWNIIYPVYLNSKKTVAEGRRIAAAKACPDPTCIEIADCCSHLKIPHAIELDKAYPRDFFQVGRVRVQLKKDDGSPVNPAIKTKKQLMIQVAELVPKHHGRTKKQEFNLRKPPSFHYDLLLLGFLTLMCGLIGIPPSNGVIPQSPMHTKSLATLK

SEQ ID NO: 35803 - DNA, 700 bp, Zea mays
  misc_feature: Ceres CLONE 1416545-F
  misc_feature: Encodes the peptide sequence at SEQ ID NO. 35804
  misc_feature (211)..(211): n is a, c, t, g, unknown, or other
  misc_feature (484)..(484): n is a, c, t, g, unknown, or other
aagctggagctccccgcggtggcggccgctctagaactagtggatcccccgggctgcaggaattcgcacgagaccattacctagaacatcctaatcgaaaaaacgatttcgctccccacagcggctcggccacaacccacagccagacggtctcgagctggatctctaccgttcgtccgttccagcagacagcagtgcgcgctctctctcntcctcgtggcgacgactgggcgaccgctgccgctgcccttgtgccccggtctccgtccgtccgttcgccaggtctcctgggggctctttggcgtccacaagctccgccaggttgctgggggaagtccaaggttggcacatggattcagcacaagatttccaacccaggacattctctataaaggtggggccaccaagggaaagcacacggatcatgcttgttgacaggatgacaaacatctgtctacagagtccattttctctcgcaaatatncgccttttgggaaagcagaggctcatgagaatgcaaaacgattgaagaactttgctttgccttggctgatgagcatttcagagaggagccagatgggggatgggagttctgctgtccagctatatgcaaaggaaacgagcaagatggtgttggaagttctgaaaaaagccccaagactactggaaaactgaaggcacctgttactgacacccttct

SEQ ID NO: 35804 - protein, 40 aa, Zea mays
  misc_feature: Ceres CLONE 1416545-F
MSISERSQMGDGSSAVQLYAKETSKMVLEVLKKAPRLLEN

SEQ ID NO: 35805 - DNA, 723 bp, Zea mays
  misc_feature: Ceres CLONE 1416553-F
  misc_feature: Encodes the peptide sequence at SEQ ID NO. 35806
  misc_feature (308)..(308): n is a, c, t, g, unknown, or other
  misc_feature (389)..(389): n is a, c, t, g, unknown, or other
  misc_feature (405)..(405): n is a, c, t, g, unknown, or other
  misc_feature (406)..(406): n is a, c, t, g, unknown, or other
  misc_feature (455)..(455): n is a, c, t, g, unknown, or other
  misc_feature (472)..(472): n is a, c, t, g, unknown, or other
  misc_feature (585)..(585): n is a, c, t, g, unknown, or other
  misc_feature (586)..(586): n is a, c, t, g, unknown, or other
  misc_feature (627)..(627): n is a, c, t, g, unknown, or other
  misc_feature (628)..(628): n is a, c, t, g, unknown, or other
  misc_feature (656)..(656): n is a, c, t, g, unknown, or other
aagctggagctccccgcggtggcggccgctctagaactagtggatcccccgggctgcaggaattcgcacgagaccattacctagaacatcctaatcgaaaacatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatcccacacaggaaaggatgnagaagaagccgaccatcctcatgaaacagtacgagcttcggcgcacgctcgggcaggccaccttcgccaagtgtaccacgncggacctcgcgtccgnngagagcgtggccatcaaggtcatcgaacaggagaaggtgatgcgcgtcngcatgatcgaccagatncagcgcgagatctccgtcatgcgcctcgtccgccacccaaacgtgtgcagctgcacgaggtgatggccaacaagaagcagatatactcccccatggagtaacgtcgggggcgnngagctcttccccccgcgtcccccggggccggtttcaagganngacgccgcgaagaaggtacttccaccangttcggtggggcgcgtcgactccttgccaaaggcgggggggttctaccacggggaccttcaacgcca

SEQ ID NO: 35806 - protein, 76 aa, Zea mays
  misc_feature: Ceres CLONE 1416553-F
  misc_feature: SWISSPROT Homolog: EC 2.7.11.1 Non-specific serine/threonine protein kinase
  misc_feature (2)..(2): Xaa is any aa, unknown, or other
  misc_feature (29)..(29): Xaa is any aa, unknown, or other
  misc_feature (34)..(34): Xaa is any aa, unknown, or other
  misc_feature (51)..(51): Xaa is any aa, unknown, or other
  misc_feature (56)..(56): Xaa is any aa, unknown, or other
MXKKPTILMKQYELRRTLGQATFAKCTTXDLASXESVAIKVIEQEKVMRVXMIDQXQREISVMRLVRHPNVCSCTR

SEQ ID NO: 35807 - DNA, 622 bp, Zea mays
  misc_feature: Ceres CLONE 1417877-F
  misc_feature: Encodes the peptide sequence at SEQ ID NO. 35808
ggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaacccgccccggcctcagcctcatccccagccacacccatgcccgtgccaacagccgcatccaagcccgtgccagctgcaaggaaacctgcggcgttggcagcacccccaatcctggggccagtgcgtcgaatttcctgaagctttcattgcaaccccaacggcgaaccccctactgctccccctcaaggcccaatcgtttccggcaacaaatgtttgcccaccaccctc

SEQ ID NO: 35808 - protein, 133 aa, Zea mays
  misc_feature: Ceres CLONE 1417877-F
MRVLLVALALLALAASATSTHTSGGCGCQPPPPVHLPPPVHLPPPVHLPPPVHLPPPVHLPPPVHLPPPVHVPPPVHLPPPPCHYPTQPAPASASSPATPMPVPTAASKPVPAARKPAALAAPPILGPVRRIS

SEQ ID NO: 35809 - DNA, 656 bp, Zea mays
  misc_feature: Ceres CLONE 1417878-F
  misc_feature: Encodes the peptide sequence at SEQ ID NO. 35810
ggagctccccgcggtggcggccgctctagaactagtggatcccccgggctgcaggaattcgcacgagaccattacctagaacatcctaatcgaaaaacctttctttccctcttccgtcttccccaacccaaccacccgcaccaagccgacccagagagaggagagcctgcttgcctgcctgggctggactcccccttcgcctcctcctcgtccgatcggccccgccccgcctagctgctgctgctgctgctgctgctgctgcgcgcgcgccgcggcgggacccgggaggagcgccggtggtggtggccgggcccgatggagtgggcgtcggcggcgtacacggctgcggcgctggtgtgcgccgcggcggcgagcgtggtcgcgctcgcgcacatctaccgccacctcctccactacgccgagcccatctaccagcggttcatcgtccgcatcatattcatggtcccggtatatgctgtgatgtcattcctttcccttatcctccctgacaacgcgatatattttaattctattcgagagatatatgatgcttgggtcatctacaattttctctcactctgctttgcatgggtgggaggtcctggtgctgtggtggtaaagcttgagtggccgaaccctgaaaccgtcgtggattc

SEQ ID NO: 35810 - protein, 113 aa, Zea mays
  misc_feature: Ceres CLONE 1417878-F
  misc_feature (5)..(112): Pfam Name: DUF300 Pfam Description: Domain of unknown function
MEWASAAYTAAALVCAAAASVVALAHIYRHLLHYAEPIYQRFIVRIIFMVPVYAVMSFLSLILPDNAIYFNSIREIYDAWVIYNFLSLCFAWVGGPGAVVVKLEWPNPETVVD

SEQ ID NO: 35811 - DNA, 713 bp, Zea mays
  misc_feature: Ceres CLONE 1417879-F
  misc_feature: Encodes the peptide sequence at SEQ ID NO. 35812
  misc_feature (320)..(320): n is a, c, t, g, unknown, or other
aagctggagctccccgcggtggcggccgctctagaactagtggatcccccgggctgcaggaattcgcacgagaccattacctagaacatcctaatcgaaaaagtactttcgctagctcccttccgttcccttcccacgaaaaccggagagggagtgagaagaagcaacaagaagcggagagccaacgcgcaacgcaacgccctgagatggcggcgccggcgccggcgccgaagcaggaggagctgcagccgcacgccgtcagggaccagctgccctccgtctcctactggctgacaagcccgcccccatggccgggaggncgtcctcctcggctttcagcactacctcgtcatgctcgggaacaccggttatcatccccaccggggttcggggccccagatggggcggcgccaagaagaaaaaggcccggggtgtggcaaaaccctgcttttccgggcgcgggaataaaacgccttggggccaaaactttcctcgggaacggcccctccccccgcggtggggggggccccctaaaacctttttggggccccccacattttcttttttttctggggggggggttaaaggggggttcccccaattccccaaagaaaaatttcgccgcccctataggggggggaaaaaaagggggcgttttttgggggccccccccccccccaaaaaaacatgggggttttaagggggtttttggg

SEQ ID NO: 35812 - protein, 169 aa, Zea mays
  misc_feature: Ceres CLONE 1417879-F
MAAPAPAPKQEELQPHAVRDQLPSVSYWLTSPPPWPGGRPPRLSALPRHAREHRLSSPPGFGAPDGAAPRRKRPGVWQNPAFPGAGIKRLGAKTFLGNGPSPRGGGGPLKPFWGPPHFLFFLGGGLKGGSPNSPKKNFAAPIGGGKKGGVFWGPPPPPKKHGGFKGVFG

SEQ ID NO: 35813 - DNA, 764 bp, Zea mays
  misc_feature: Ceres CLONE 1417880-F
  misc_feature: Encodes the peptide sequence at SEQ ID NO. 35814
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
  misc_feature (53)..(53): n is a, c, t, g, unknown, or other
nnccccccccnnnnnnnnttaatttttgtggnnntgtgnttagggagtttttnttaaaactgggactccacgcggtggcggccgctctagaatagtggatcccccgggctgcaggaattcgcacgagaccattacctagaacatcctaatcgaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaacccctactcaaccgccccgggcctcagcctcatccccagccacacccatgcccgtgccaacagccgcatcccagcccgtgccagctggaggggaacctggcggcgttggcagcccccccgatccctggggcccagggcgtccaagttccctgaaggcattcagtgcaacccccgaagggcgaaccgcccttactggcctcgcccctcaagtggcccaggtccggttggccggggccagcacagtggtttggccccagccaagccctccagggggcaggggtggg

SEQ ID NO: 35814 - protein, 84 aa, Zea mays
  misc_feature: Ceres CLONE 1417880-F
MRVLLVALALLALAASATSTHTSGGCGCQPPPPVHLPPPVHLPPPVHLPPPVHLPPPVHLPPPVHLPPPVHVPPPVHLPPPPCH

SEQ ID NO: 35815 - DNA, 559 bp, Zea mays
  misc_feature: Ceres CLONE 1417882-F
cccgcggtggcggccgctctagaactagtggatcccccgggctgcaggaattcgcacgagaccattacctagaacatcctaaatcgaaaaacatcgacccagccatctccctcaccctcgttcacacacagtcccgccactcctttagtaactttgtgatttgtacctcgaccaaatcactgggccgggtggcgggacaacaacccctggggaaagggaatggggggtccaccagggggggggttccccccgctcccccgggtgttttttggtctaaaaccccccgcccgggggaaagaaaaaattgtccaaacggcccccccggagggacccccgggggggccaacaaggcgggccttatggggttacaaaaaaaaaccccccccccaaaaaaaattttttaaaaggttgcccccccggccccccaaaattataaatggggaaaaaaaaaaacccccgggaaacaccccctctcccccccccccaaggggggagagagggggccaatcttttcccccccccaaaagaacccggggaaaaaaaaaaaaaaaaagggggg

SEQ ID NO: 35816 - DNA, 729 bp, Zea mays
  misc_feature: Ceres CLONE 1417885-F
  misc_feature: Encodes the peptide sequence at SEQ ID NO. 35817
  misc_feature (20)..(20): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
tccccccccttttttttttntttttttttattttcgggggggggcnnnnncccnntaaactgggactccccgcggtggcggccgctctagaatagtggatcccccgggctgcaggaattcgcacgagaccattacctagaacatcctaatcgaaaaacaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactcttcagaacaacaatttcttccattcaacccaattgtcttacattggaacggtgctggcttatttggcagccaacaaactatttaccctttccagcccaggctagcctaactggcccaactcctccaggcaacaaacaacctttctttccctttttaaacccaaat

SEQ ID NO: 35817 - protein, 149 aa, Zea mays
  misc_feature: Ceres CLONE 1417885-F
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALANLSPYSSEQQFLPFNPIVLHWNGAGLFGSQQTIYPFQPRLA

SEQ ID NO: 35818 - DNA, 749 bp, Zea mays
  misc_feature: Ceres CLONE 1417886-F
  misc_feature (1)..(1): n is a, c, t, g, unknown, or other
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ncccaaaanccnnnnccnnnnngggggnggggggnnnnnnnannnnnnnnnnnnaaaaactggagctccacgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagctgatggctacatcagagcccagacaagaaagtttggtggtgcactactcacaacctagaaggcccccgggtccatccttgctgccttcaggaagtgtaacccgctataaaaatttgaaaaccctttggccgtaaccttctcttaaatggagcaaaaaggccccaagcctgtggggcacccagggtcgatcctttggaaacttcggttgaaaaagatcattctcctacgcaaagagggacatgcggttctaattacccctgggatgaaatgactagc

SEQ ID NO: 35819 - DNA, 810 bp, Zea mays
  misc_feature: Ceres CLONE 1417892-F
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (34)..(34): n is a, c, t, g, unknown, or other
  misc_feature (39)..(39): n is a, c, t, g, unknown, or other
nccccccnnncccggggnnnnnttggggttaggntagangtggagacgcgggtttctccgtgggggctcccgggggtggcggccgctctagatctagtggatcccccgggctgtaggaattcgcacgagaccattacctagatcatcctaatcgaaagaccggaccgcgcctcgctctctcttgtctcggccgctagatcccttcctttcctcccaccgcgcccggctgccccaacatcccccctccccgctccgctccacgcacggctccagatctgctacggcggcggccggtggacgccgccccgcgggtgccggacgcagtgacgtgagcggcggatcctgaccggccgtgccatcgctgcggacggatgaaagcgtaagcggggggcggtaaaacagctgcccccccggcccctactcccctaggttctttcgccggtgtgctccttttgaaagcaaaacgggtaatggaggggtggaatacccccccactggcctgggcacaggccagggaaagagcgtttaccgattacctatggttgggcaaaaacaacggggcttggtgacagccgacctcccataggttctttggccgtattcacacccccaccccggaagcaggggagcctcactgggaaagcgcgttgggtaccttcctgtctaaccggcccggtaccccacgggagccagtcccccgccgaaaaaacggaaaacccaggcggccattgaaaaaccccgtttgggtgttgccgtttaatggacccccgagcaagaggccttgaaaagctcgcttcgggagaccttgag

SEQ ID NO: 35820 - DNA, 771 bp, Zea mays
  misc_feature: Ceres CLONE 1417893-F
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
gagaagggagggggggaaaaaggggagagggggggggggggtgggcggggngnnnnaaaactggaactccccgcggtggcggccgctctataatagtggatcccccgggctgcaggaattcgcacgagaccattacctagaacatcctaatcgaaaaaacgacgcgattggcgattccatttctaccccgagacctccagccgtccgcccctgaaccctcagccttctccgtcccgcctcggcactcgacggccgccggcacacaccgcgcagtctcgagacaggtaacccgctcccctctccgctgaactcctctcccaacaaggggccagcctcacccccaacgcccatctaagccaagtgcacggtgctgctagatcccgatctcgttctgccaaccgccgagggagggttgcgctcgccggatcccgcccgagtcacgtgcggctttgattcgctgcacctgtcgtgcaggaaccggaggaacgaggatggaggatgactcgccgctgaacaaaaacaatgaaagggggcggtgaaaggaactcgcccgcggggaacccatcttggggcaccgttccttccgccacctgggtacgaacgttggccccgtggtggaaggcgcccaccgtcgcggctccctggggcctttactccgggaacgcctcaaagaatgtggcggacacccttaacggggggccccacctttcccgccaccatatcggggggggcctcctttactttccggggggttcaaaaccaagcttcggg

SEQ ID NO: 35821 - DNA, 684 bp, Zea mays
  misc_feature: Ceres CLONE 1417905-F
  misc_feature: Encodes the peptide sequence at SEQ ID NO. 35822
ggagctccccgcggtggcggccgctctagaactagtggatcccccgggctgcaggaattcgcacgagaccattacctagaacatcctaatcgaaaaaaggaaggagaggggagcgagcgagcgagcaaccggcggcgacagccatggcggagcagcacaaggaggagtcgggcgtgacagtgctggacaagatctccgacaagctccacgggcgagggggcggctcgtcctcgtcgtcggactcggacgacgagcgctcgtcggcgacggccgccgtgaaggccaagatctaccgcatcttcgggcgcgagaagcccgtgcactccgtcctcggcggcggcaagccggccgatctgtttctatggaggaacaagaggatctctggtggggtgctccgaagggcaactgcccttcgggctgctggttgaggccatggattaccccctcctcaccctgttatggccctggcttcatcctccccctggccttcctggtccctctgggcccaatggccccaattttttataaaaagacttccctcctaaaactccccagaggggaaaaaacccccaaaaacccccgcctttgaaaaatggtcccaccctcccccgaaaaaaataagaaaaacaaagggggttttttcttccccctttgggggaaaattggcccaaaagcgcctttcac

SEQ ID NO: 35822 - protein, 94 aa, Zea mays
  misc_feature: Ceres CLONE 1417905-F
MAEQHKEESGVTVLDKISDKLHGRGGGSSSSSDSDDERSSATAAVKAKIYRIFGREKPVHSVLGGGKPADLFLWRNKRISGGVLRRATALRAAG

SEQ ID NO: 35823 - DNA, 653 bp, Zea mays
  misc_feature: Ceres CLONE 1417916-F
  misc_feature (290)..(290): n is a, c, t, g, unknown, or other
ggagctccccgcggtggcggccgttctagaactagtggatcccccgggctgcaggaattcgcacgagaccattacctagaacatcctaatcaaaaaagcttgttgctgctgctgaaggaaaagacaattttctccttacctcctgggctcaggcctcaggcgcacagccttctgcttctcttcctctcctcgcgtccccccaccaaaccctaacccgagcacccagcccctcctcgcgtctgctcgcgccggccttttgggctctcactctgagcggcagggacccgcanggctccggttgtgttcaagaaacatcccagttgttggccagaaaccaaaaaatggccgaaaaaaggaaggaaaccaaaggtttggaacccgaaaaaaaattggaaaaaccgggaaacccggaaaggggaaggccaaaaaaagggggaaggaaaaattcccccccctttcaagggttcttaaaatcgggccccggggcgttaaaaaccccccccccattaacggaacccccccccaaagaaacccccctcccccccaaattggcccaaaaaaaaatactttttctcccaaaaatggtgttgggtgggggaaaaaaaaaaagggtggggggaaaaattttttaaaaaaaaaaaaaaagggggggg

SEQ ID NO: 35824 - DNA, 817 bp, Zea mays
  misc_feature: Ceres CLONE 1417919-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (30)..(30): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (49)..(49): n is a, c, t, g, unknown, or other
  misc_feature (799)..(799): n is a, c, t, g, unknown, or other
nnnnnnnnnnnnnnnnnntttcccccaaanccatatcnnnannanccanccaaaaaatacaaacaggaactcaccgcggaggcggccgctctagaactagtggatcccccgggctgcaggaattcgcgcgagaccattacctagaacatcctaagcgaaaaactccgcctgcatctccaaagacactgctccctctggcttcccgcctcctcttcggctccttcgcgtcccgacgccccctcatgggacaaactgaacggccggccaaccgcaaacaaacaagcagaaaatcttccttccccccaggcctgccgcgtggaaacaacccggggacctgccgcccaaccttcgcggacggggggattcccgtccaaccgttttggagttggaaaggcccacctcccccgtcttttttcttccttcccaaaaatcatggcaggatcccggggccaggggggactttccaccttggggatggggccaaaaacaccccattgtattaagcttagcgagacctcagaaaacaaaaagcgacaattgatataaaaaaaaaaaaaatcggcttgaccccgaaagagccctgtaccaaaaaacccccaccccaaactcaagcttttcgcggtctaatattaaaccaacggggtgctcattcttctttgtagatgttcaccctcacttgcggcaaaaaaacagggccaacatgcagtcacccctataacacccccctttatggaaaccaaacatccgatgggaaatttaaaaatgggctccttagggtataaaaacaccaattaagctntccgggagtccccagctg

SEQ ID NO: 35825 - DNA, 608 bp, Zea mays
  misc_feature: Ceres CLONE 1417921-F
tcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaaggccgtggcaagaatcaggagagagatagcaggggggctacctagctgagctcgtgcaacaaagaatgcccggaatttgcaggaacatggtggcggcccctcctggtgctcaacctcatcatggacatcatcgtcatcgggtttcgcgaggtggaacctgaaccacttcatcaaaggggcaaaaccactacccccggtgtggccgggaaccggcgccacctttctactttcctggtggttcccccatcctggcccggcgttggtgggccgcccccatcccaaactgtgggggggggggcccaccacttgcgccgcgcctgggggcccaacgaaaagcctggggtcaccaaaagcgccgccgtcgtatccgctt

SEQ ID NO: 35826 - DNA, 630 bp, Zea mays
  misc_feature: Ceres CLONE 1417922-F
tggagctccccgcggtggcggccgctctagaactagtggatcccccgggctgcaggaattcgcacgagaccattacctagaacatcctaatcgaaaaagaagcccagaacttaaacctggaagcctggaggatggaacgggtactagcttgctagggttcgtgtccggcggcggcgactgcagctggaacgccggcggcgcagctcagtggatgctcccatcgaccattcccaggtttggttctccctcatccggtcctcctccatgtctccatggctgaatcactatcgttctcttctcacgcacgtcatgttgtcaaatccatcactggctttagctcccgtgatctgatcaacagcaaaacgaactcactacacactatgccactatggcatggagtttaattatgagacaatgtaaagactagagcgagtccactaatcacgggtggccaaagaaattcacccgaccaggccttcagagtttagtattttactattattcgtcaccaccctgctacatgattacttgtatataaatagagggcacacgacaccatccctgtaggttgtagtcttgtgatcttgtccttggaggacacacaaagactggtaacacagacgacctctg

SEQ ID NO: 35827 - DNA, 768 bp, Zea mays
  misc_feature: Ceres CLONE 1417978-F
  misc_feature: Translation starting site: 288
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
ccacccccatggggngnnganannntataatcgctntnnanaacaattctctctcaagctggagctctccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcattctcgcgccagtggaagtcggaggtggagtcgccggactaccaccgccagcgccgggcggaagggctggcgcgcccggtgctcgcgttggtccaggcgcagccgaaagcgccgccggatgacgactacaaagccgggccccgctgcaaaagcgctccaacgcggccaactccaaccggcctggtgctgctcggaaccgggccaggggacggtggaatgtcgctcgtccgcctcccgcctgggggcaaagcccagaggcctggccttctggttcctgcccaagctggcccgcccgcccgttgggaccggcggcacgacaaaaggggcaaggaaaaaaggccttgcctgggcaggggcgggcccgcgtgtgcattggggcaaaccctgggatgaactgggggaccgtgcccccaaccgg

SEQ ID NO: 35828 - DNA, 670 bp, Zea mays
  misc_feature: Ceres CLONE 1417981-F
  misc_feature: Encodes the peptide sequence at SEQ ID NO. 35829
  misc_feature (268)..(268): n is a, c, t, g, unknown, or other
  misc_feature (381)..(381): n is a, c, t, g, unknown, or other
  misc_feature (575)..(575): n is a, c, t, g, unknown, or other
  misc_feature (670)..(670): n is a, c, t, g, unknown, or other
tggagctccccgcggtggcggccgctctagaactagtggatcccccgggctgcaggaattcgcacgagaccattacctagaacatcctaatcgaaaaacacccatgtccacctccgtctccgccgccgccgttgccgctctcgtcccacccctcaccggccgccggtcgccgccggcatctcgcgtaccgcagatttgccgcagaagatcagatccaaaccccgtatcttctcttcttccccctccttccccattgtccccgccgctngcatggccaccggcggcgccgcccccaccgcctccgatgccgggtccaagaagaagttgctcatcttcgactcggaggaggatctcgcggtttctcttgccaagtacactgcnggagctgtcggaaaaagttcgcggccgaagaggggtgcctttcaccgcccgtgctctctgggggaatcccctcctccagggcactccagaaaacctgaacggagcccgcccttaccctgggattccgggggaattgggaaccaagggggccccttccttctggggtggagaaaaaaaagggccctggccccaangggaccctgggggaataacaaaactataaaacctccccccaaaggaagggggtttcctcccccccagggtggcgccaaatacccccccctgggan

SEQ ID NO: 35829 - protein, 133 aa, Zea mays
  misc_feature: Ceres CLONE 1417981-F
  misc_feature (102)..(102): Xaa is any aa, unknown, or other
MATGGAAPTASDAGSKKKLLIFDSEEDLAVSLAKYTAGAVGKSSRPKRGAFHRPCSLGESPPPGHSRKPERSPPLPWDSGGIGNQGGPFLLGWRKKRALAPXGPWGNNKTIKPPPKGRGFPPPQGGAKYPPLG

SEQ ID NO: 35830 - DNA, 772 bp, Zea mays
  misc_feature: Ceres CLONE 1417988-F
  misc_feature: Encodes the peptide sequence at SEQ ID NO. 35831
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (17)..(17): n is a, c, t, g, unknown, or other
  misc_feature (44)..(44): n is a, c, t, g, unknown, or other
  misc_feature (46)..(46): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
nnnnnnggggaacaccnccgggggggacggcgcgggcgggctcntntttttnnnnnnnnaaaagtggagctccccgcggtggcggccgctctagaactagtggatcccccgggctgcaggaattcgcacgagaccattacctagaacatcctaatcgaaaacgaacacaccagaccagctcatcatcacattcgcatacatctcttctagcacgcaaagatcgagctatagctagctctgcaaccagagacaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactgggtgaaggccacgcccgcccgtcgacgccaagggggcaaggaggcgcgccacccgcccgattgccggggaggaagccgccgggcgcccgagaaaggaagcaaggcgtgaccccggagaacggggccccccgggagcccaagggcgcccgggggtggggttgggccgccggggaaggcccgaaaccggaagaagttggcttcccagcaggggcaagacaacaaggcagggggggccggccgcccaaaaacgaggaagggcgggcgggctggacgggcgggcgggccccccctgggttgcccccggggaatccttctaagccagcgccggccccacaaaaacccccaagacatgtttggggaagaacagccggcccccc

SEQ ID NO: 35831 - protein, 154 aa, Zea mays
  misc_feature: Ceres CLONE 1417988-F
METVVGDLMATELRLGLPGTVDDCSQPQLGEGHARPSTPRGQGGAPPARLPGRKPPGARERKQGVTPENGAPREPKGARGWGWAAGEGPKPEEVGFPAGARQQGRGGRPPKNEEGRAGWTGGRAPPGLPPGNPSKPAPAPQKPPRHVWGRTAGP

SEQ ID NO: 35832 - DNA, 624 bp, Zea mays
  misc_feature: Ceres CLONE 1417990-F
  misc_feature: Translation starting site: 348
tggcggccgctctagaactagtggatcccccgggctgcaggaattcgcacgagaccattacctagaacatcctaatcgaaaaaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggcccggaattggcaggaacatggtggcgcccgctcctggtgctcaacctcatcatgtacatcatcgtcatcggcttcccgagctggaaccctgaaccactttctcaacgggcaaaccaactacccccggcgtggccggcaacggcgccactttccatttcctggtgttcccatcctggcccggcttggtgggccccgcgtccaatcttggcgggcgtgcacacgtgcggcccctggccccacaaaagcctggccccccaactcccgcttcttcg

SEQ ID NO: 35833 - DNA, 601 bp, Zea mays
  misc_feature: Ceres CLONE 1417994-F
  misc_feature: Translation starting site: 163
ggatcccccgggctgcaggaattcgcacgagaccatacctagaacatcctaatcgaaaaaactactccgtcactttgtttacaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcatcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggccctgaccgcctccgtggtggggctggccgtggccaccccggtgttcctgatccttcagccccgtgctcgtccccgccgcgctgctcatcaggacggccgtcatggggttccctcccccaggcgccctgggggctcgggggcctgtccccccctcacgtgcctcgccaaccccggcgcgggagggcttttcaacggcacccccggactacgtggaagaaggccccccccccaggatg

SEQ ID NO: 35834 - DNA, 610 bp, Zea mays
  misc_feature: Ceres CLONE 1417996-F
  misc_feature: Encodes the peptide sequence at SEQ ID NO. 35835
cgcggtggcggccgctctagaactagtggatcccccgggctgcaggaattcgcacgagaccattacctagaacatcctaatcgaaaaatttgtttgggtaagttcggtgctgcccagcaggtggagaaccgaggcgcgctgtccaaaaggtcacgtaacgacgagaatgatgccaggacctcctgcttctggatatgaccggtcacctctattttacggaggaggtggtggcgccccacctccaattccgcttggaactggtagctatggtgctccatatccacaccttgggatgcgatatggctatggtccaccagtaggacctcctggttcatacggtcttttctcttcatatggtccacctgggccaatgagtggtatgggatatggcccaggacctgagctaggccgatatagctatgggtttagaggttctccaatgccggtttctagcccatggtctggtggagcattacctgaaaacactgacaacattgcttcacaaaacgccctgggaggccctgatggacttttctgagggggattggccttgtcccaaatgcaacaactttaatttttcctttcaaaagcacttggaaaaaggaaaaaa

SEQ ID NO: 35835 - protein, 123 aa, Zea mays
  misc_feature: Ceres CLONE 1417996-F
MMPGPPASGYDRSPLFYGGGGGAPPPIPLGTGSYGAPYPHLGMRYGYGPPVGPPGSYGLFSSYGPPGPMSGMGYGPGPELGRYSYGFRGSPMPVSSPWSGGALPENTDNIASQNALGGPDGLF

SEQ ID NO: 35836 - DNA, 609 bp, Zea mays
  misc_feature: Ceres CLONE 1417998-F
  misc_feature (409)..(409): n is a, c, t, g, unknown, or other
tggagctccaccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagcatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcgggggaagaagagtcgncggcggcgcgcctccagtctttttttcgcctccgtgctctccgggctcttcggccaggccgaagcccgaggacgaagaacaaagacaaaaagatggcccacccgcaaacaacaacgctggccgcgggtggccgctcccgccacatcacccatcaaaacccgaaggggggcccccccccctcttggaaaaaaaaaaaggcg

SEQ ID NO: 35837 - DNA, 852 bp, Zea mays
  misc_feature: Ceres CLONE 1418002-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (55)..(55): n is a, c, t, g, unknown, or other
  misc_feature (852)..(852): n is a, c, t, g, unknown, or other
nnnnnnnnnnnnnnnnnnnnnnnnaaaanaaaaaaangaannggaannannnttnttttttcaaaactgggactccccgcggtggcggccgctctagaactagtggatcccccgggctgcaggaattcgcacgagaccattacctagaacatcctaatcgaaaacccgagagaggatacaaaggcacccggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaaggcggcgactttcttccgtcaagtgggggctgggccaaatgctcccggggcgggggccatctgggactgggttgacccccggaacagggcccccccccccgaaagaaggccccgcccccgtgcccccgagatgggcccttgaaaacgggtccccccgccaaaaattccccgcgaaaaggggggggggggggcccccattttttaaaacccgggggctcttttccccgggaaaataagagggccgccgccctcccccatccccccggttttagtggacaaagggcccccctttatggggagaatttttgggggggggcgcccacaaattctccgggggggcggggggggcgtcccctatcatccgcgggaaaataaaaaggagggtggttttacccccccccccgagaaaaaaccccccccataaattaaatacaaaaaataatttggcgcccccctctcttttggggggggcgggcccccccccccaagagaggactccctccgtggggggggggggggcgcn

SEQ ID NO: 35838 - DNA, 630 bp, Zea mays
  misc_feature: Ceres CLONE 1418006-F
  misc_feature: Encodes the peptide sequence at SEQ ID NO. 35839
acccgcggtggcggccgctctagaactagtggatcccccgggctgcaggaattcgcacgagaccattacctagaacatcctaatcgaaaaacaaatcgataggctaaggaagctccatcgatcctgcgttattttgccggtaattgattgatagatggcgtcggagaagagcaagatcctggtggtcggcggcacggggtacctgggcaggcacgtcgtggcggcgagcgcgcggctgggccaccccacctcggcgctcgtcagggacacggcgccgtccgacccggccaaagcggcgctgctcaagaccttccaggacgccggtgtgacgctcctcaagggcgacctgtacgaccaggctagcctggtgagcgcggtgaagggcgcggacgtggtcatctccgtgctcggatcgatgcagatcgccgaccagagccggctcgtcgacgccatcaaggaggccggcaacgtcaagaggttcttcccctcggagttcggcctggacgtggaccgcacgggcatcggggagccggcccaattccttcctaggcgccaaggtgggcatccgccgcgccaccgaaggccgcggggatacccttcaccctacgccggggggcggcttcttccccg

SEQ ID NO: 35839 - protein, 158 aa, Zea mays
  misc_feature: Ceres CLONE 1418006-F
  misc_feature (8)..(153): Pfam Name: NmrA Pfam Description: NmrA-like family
  misc_feature: SWISSPROT Homolog: EC 1.3.1.45 2'-hydroxyisoflavone reductase
MASEKSKILVVGGTGYLGRHVVAASARLGHPTSALVRDTAPSDPAKAALLKTFQDAGVTLLKGDLYDQASLVSAVKGADVVISVLGSMQIADQSRLVDAIKEAGNVKRFFPSEFGLDVDRTGIGEPAQFLPRRQGGHPPRHRRPRGYPSPYAGGRLLP

SEQ ID NO: 35840 - DNA, 682 bp, Zea mays
  misc_feature: Ceres CLONE 1418010-F
  misc_feature: Encodes the peptide sequence at SEQ ID NO. 35841
ccccgcggtggcggccgctctagaactagtggatcccccgggctgcaggaattcgcacgagaccattacctagaacatcctaatcgaaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccgggcggcctctccgtgagctcctgttctgctgccttggggcccctcagacatcagcggggggatccttcttcaggaaaccctcctccagaaaacaaaggagggcaggccttttgccaagttccccaagggagggaaggctcccccccgggcttcaaggcaaaaaggggccccttggggtttgtgggcccccaaaaggaaaacccccccccggggccccaaaaaacccccggaagacgctggccttaaaatttaaaaagggcggggccccctttttcaaaaggggggggtggttttccaaaaaggggcccccaaagaacgccccccaattgtttattttaaacaaaataggcgggggg

SEQ ID NO: 35841 - protein, 56 aa, Zea mays
  misc_feature: Ceres CLONE 1418010-F
  misc_feature: SWISSPROT Homolog: EC 4.1.2.13 Fructose-bisphosphate aldolase
MSAYCGKYADELIKNAAYIGTPGKGILAADESTGTIGKRLSSINVENVEENRAASP

SEQ ID NO: 35842 - DNA, 777 bp, Zea mays
  misc_feature: Ceres CLONE 1418072-F
  misc_feature: Encodes the peptide sequence at SEQ ID NO. 35843
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (741)..(741): n is a, c, t, g, unknown, or other
nccccccccnnnnnnnnnnnnnncggcnngcnnnnnnnnnngatgtcccgaatttaactggagctcaccgcggtggcggccgctctagaactagtggatcccccgggctgcaggaattcgcacgagaccattacctagaacatcctaatcgaaaacccgttccaactcctacctacgcagcagaggccagccacctccccgtcgctctcacgctcttcgtgcccgccgcctctcctccgtctctgcctctctccctctcccctcccgtctgacgcacatggcctccatcgccggatcttcggccctctccttcgccaggcccgtcaaggcaatcaacacaaattctctagctttctccccggcgaggaagggcaacacattcctccgcctgcaaccaatgcctaatgagatctgtttcctgcgctgccaagaaggatacaacagacaaggtttgtgagattgtgaagaaccagcttgctctttcctgaccataactgaagttttggcggtgaaatcgaaatttcctccgaacctcggtgcaaaattcccctgggacaccggtttgaaattgtggagaaatctccgaagaacaccttccaacattaagcgggggaaggaagtcccagggcgacataaccaatcggccctcggcttggagagaacgccgggggagacctcaagccgaacaaagccttggtttcgcttggggaaaaagctggaaatcttcctggagaccctccnctcatagtcggtgtggtccgtataacaagttacatg

SEQ ID NO: 35843 - protein, 59 aa, Zea mays
  misc_feature: Ceres CLONE 1418072-F
MASIAGSSALSFARPVKAINTNSLAFSPARKGNTFLRLQPMPNEICFLRCQEGYNRQGL

SEQ ID NO: 35844 - DNA, 624 bp, Zea mays
  misc_feature: Ceres CLONE 1418075-F
  misc_feature: Encodes the peptide sequence at SEQ ID NO. 35845
tggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagaccccagaatgcatggagcggtgccccccgccgcggactggccgtcgacatggagcaagaatacggtccgcggcagcgaaagcgcgggccaattgccgga

SEQ ID NO: 35845 - protein, 143 aa, Zea mays
  misc_feature: Ceres CLONE 1418075-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETPECMERCPPPRTGRRHGARIRSAAAKARANCR

SEQ ID NO: 35846 - DNA, 736 bp, Zea mays
  misc_feature: Ceres CLONE 1418090-F
  misc_feature: Encodes the peptide sequence at SEQ ID NO. 35847
  misc_feature (1)..(1): n is a, c, t, g, unknown, or other
  misc_feature (2)..(2): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (28)..(28): n is a, c, t, g, unknown, or other
  misc_feature (39)..(39): n is a, c, t, g, unknown, or other
  misc_feature (45)..(45): n is a, c, t, g, unknown, or other
  misc_feature (53)..(53): n is a, c, t, g, unknown, or other
  misc_feature (56)..(56): n is a, c, t, g, unknown, or other
nnccccccccccccnnnnngnngggngngcgaggggggngagggngaacaatnttnttaatactggaactccaccgcggtggcggccgctctattttagtggatcccccgggctgcaggaattcgcacgagaccattacctagaacatcctaatcaaaacttttgccttgcctgcctgccttccttctcgtagaagataagcaaagcaaggcaaccgttgtcgttgtctctgttcctccgcttcctgctctcttggcttgctgcttgccctcggagcagtgccttccgccgccgccgccgccgcctgttgtgagaaggagaggccggggctgggaggagatgagcgtgaccaagttcatcaagtgcgtcacggtgggggacggcgcggtgggcaagacctgcatgctcatctgctacaccagcaacatgttccccacggattacatccccacggtgttccacaacttcagcgccaacccccccgtggacggcatcatcgtcaaacttgggcctctgggacactgcgtgaccacacgactactgcagaattgcggcaactgaacttaccggggcgcagaaaatggttcgtggctggctcttctccctagaacccgcagggacgaacctatggaacaacgtccctttaaacaaagtggggtgcccaataaaacttcgccttaattccaccccccacgaaatttccccgggtccatttcctctgatcaagtaacccaca

SEQ ID NO: 35847 - protein, 73 aa, Zea mays
  misc_feature: Ceres CLONE 1418090-F
MSVTKFIKCVTVGDGAVGKTCMLICYTSNMFPTDYIPTVFHNFSANPPVDGIIVKLGPLGHCVTTRLLQNCGN

SEQ ID NO: 35848 - DNA, 733 bp, Zea mays
  misc_feature: Ceres CLONE 1418091-F
  misc_feature: Encodes the peptide sequence at SEQ ID NO. 35849
  misc_feature (1)..(1): n is a, c, t, g, unknown, or other
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (22)..(22): n is a, c, t, g, unknown, or other
  misc_feature (30)..(30): n is a, c, t, g, unknown, or other
  misc_feature (45)..(45): n is a, c, t, g, unknown, or other
  misc_feature (46)..(46): n is a, c, t, g, unknown, or other
  misc_feature (57)..(57): n is a, c, t, g, unknown, or other
  misc_feature (58)..(58): n is a, c, t, g, unknown, or other
ngggggggggnggnnnngggnnggatgggngggtggaaagggggnnggggaaagagnngacaaactggagctccccgcggtggcggccgctcttttctagtggatcccccgggctgcaggatttcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgctagctgtgttcaatcaaagcttaattaggctccctctacatctgatccagctaagtagctagccagcactacagaagggcgtggcaagaatcacgagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgtcgacgttctacttcctggtgatcgccaatcctggacaggcgaggagaggcacggagaaccaagactgggcgggcggtgcagccacggagacgcgccctgggcggccagcgaacaggcctgggaccaaccaaagcggcaccggcagccgatccgccctcaatccgcgccgggggggcacgagagac

SEQ ID NO: 35849 - protein, 110 aa, Zea mays
  misc_feature: Ceres CLONE 1418091-F
MAGIGRNMVAPLLVLNLIMYIIVIGFASWNLNHFINGQTNYPGVAGNGVDVLLPGDRQSWTGEERHGEPRLGGRCSHGDAPWAASEQAWDQPKRHRQPIRPQSAPGGHER

SEQ ID NO: 35850 - DNA, 639 bp, Zea mays
  misc_feature: Ceres CLONE 1418092-F
  misc_feature: Encodes the peptide sequence at SEQ ID NO. 35851
acccgcggtggcggccgctctagaactagtggatcccccgggctgcaggaattcgcacgagaccattacctagaacatcctaatcgaaaaactcgctctctcccctctggctctgagtggcgctagtgggcgaccgccgccgcgtccctccgtcaggtgcccaggtgtagcctcgtcggcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagc

SEQ ID NO: 35851 - protein, 127 aa, Zea mays
  misc_feature: Ceres CLONE 1418092-F
MSVLTCVIESMGSSCSRSHSFDEAEAAENAKSADIDRRILQETKAEQHIHKLLLLGAGESGKSTIFKQILYEGAKELAQVEPDSSKYVLSPDNQEIGEKLSEIGARLEYPSLNKERVQDVRKLWQDP

SEQ ID NO: 35852 - DNA, 656 bp, Zea mays
  misc_feature: Ceres CLONE 1418097-F
  misc_feature: Encodes the peptide sequence at SEQ ID NO. 35853
ccccgcggtggcggccgctctagaatagtggatcccccgggctgcaggaattcgcacgagaccattacctagaaatcctaatcgaaaaatatatctccccgcgtccgctagccctagccgccgtccgccgacttcatcgtcgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccagggaaggtgtgtgatctgtggaggagtcggcatctcagacgcttactactggcaagagtgcacccagcaggagaaagaccgggaacggttgcccccagatcgtgaatctcgaaagcgcccaagaacggatctcttctatgagcgcaagaagtatggttttaagaaaaaatgaccgagaagatggagctgtgtggtggttaactttgggtggtggggcctgttctatggccccttgatactggaaataagcagctgaaacagcacctttgtattcccggttagggtttgatttgaaacgggg

SEQ ID NO: 35853 - protein, 111 aa, Zea mays
  misc_feature: Ceres CLONE 1418097-F
  misc_feature (1)..(107): Pfam Name: PHF5 Pfam Description: PHF5-like protein
MAKHHPDLIMCRKQPGIAIGRLCEKCDGKCVVCDSYVRPCTLVRVCDECNYGSFQGRCVICGGVGISDAYYWQECTQQEKDRERLPPDRESRKRPRTDLFYERKKYGFKKK

SEQ ID NO: 35854 - DNA, 703 bp, Zea mays
  misc_feature: Ceres CLONE 1418104-F
  misc_feature: Encodes the peptide sequence at SEQ ID NO. 35855
  misc_feature (310)..(310): n is a, c, t, g, unknown, or other
ctccccgcggtggcggccgctctagaactagtggatcccccgggctgcaggaattcgcacgagaccattacctagaacatcctaatcgaaaaattttccactttccactctgcctccgctgccgatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattncatgttgttgttgagatcacaaagggaagcaaagtcaaatacgagctttgacaagaaaactgggactggattaaggttgatccaagtccttttactcattccggttggatacccctcccaaatattggttttccttcccaagggacctctttgtggaaaacaaatggaccccaatgggaatggggttgggcccctggaaagccaaggaaccttggttggttccccgggttcccgttcccgggaaaaacttaaaaccaattgggccccttttgccccacttggttttggcccccggggtgtaaaaaaggggttttaacccggatatattttccccttttttggggcggaaagaaaaccccggagaaacccccgggcctctaaaaaaaaaaaaat

SEQ ID NO: 35855 - protein, 67 aa, Zea mays
  misc_feature: Ceres CLONE 1418104-F
  misc_feature: SWISSPROT Homolog: EC 3.6.1.1 Inorganic diphosphatase
  misc_feature (51)..(51): Xaa is any aa, unknown, or other
MSEEDKAAASAEQPKRAPKLNERILSSLSRRSVAAHPWHDLEIGPGAPAVXHVVVEITKGSKVKYEL

SEQ ID NO: 35856 - DNA, 794 bp, Zea mays
  misc_feature: Ceres CLONE 1418105-F
  misc_feature (6)..(6): n is a, c, t, g, unknown, or other
  misc_feature (12)..(12): n is a, c, t, g, unknown, or other
  misc_feature (13)..(13): n is a, c, t, g, unknown, or other
  misc_feature (53)..(53): n is a, c, t, g, unknown, or other
  misc_feature (794)..(794): n is a, c, t, g, unknown, or other
aaaaangggggnnaaccaaccggggacgcgcccacaccccccacaacccgagnaaaaaagaggagagacaccaggggctcaccgcggtggcggccgctctagaactagtggatcccccgggctgcaggaattcgcacgagaccattacctagatcatcctaatcgaaaacccggcccgcgcctcgctctctcttgtctcgcccgctagctcccatcccagcctcccaaccgcgcccgcctgccccaacattcccccctcccccgctccgctccacgcacggctccagattctgctacggcggcggccgggtgggacgcccgcgccgcgcgtgccggaggcggtgaacttgagcggcggaatcccttgcccggcccgtgccatccctggcaacgatgaaaagcgtaaagcggggcgggagaaacgaacggcgccccccccgggccccctacttcccgaaggtcttttgggcgtggggccccccttgggaaaaaaaaattgggcaaattaaaggggtggaaaacccccccccaattgggcagtgtgggcaaaggtccaaggggaaaaagcctttttccctaattacctaatgggggcaacaaaaaacctgttttttagaaaacccacacccccccggggtcgcgtggcccggaattccaaccccctccccccaaaaaaaaggaaccttttaccgggaaaacccttttgttccctacctctccggtttacccccccgcgggagaaccctgtgtaaaaaaaagtccccgataataaagaaaagaaaaacaaccagccn

SEQ ID NO: 35857 - DNA, 674 bp, Zea mays
  misc_feature: Ceres CLONE 1418167-F
acccgcggtgggcggccgctctagaactagtggatcccccgggctgcaggaattcgcacgagaccattacctagaacatcctaatcgaaaagaccttcaattcccctgcctgttgccgtacgtgcctaagctagcttcgtcgtctcgttgcacgtacgtagtagctagacagccgaatcggctctctagctagctcctcccttccgatcgatatcatcgccatgtcggggatctcgctggtggtggcggccagtccgacacgggacacgaggtcgtagcagcaaccgacggcgatgctggggcggcgtggatggctcccctccgcctcaaccaactgcgactggtggccctcttcatgggggttctcggcggtcgggcttccttccggttattcgaacctcctgggtccccccgtcgccacccacaatttaacttcttgggcaatttcccgggcttggccttttccggccgctggacggcgcaattaattcaaccaaaaccttgaataacccccttggtttcccccccgccccccccttcccaattgttcccccggaaaaatttttcccggggaaaaaagattgttttcccagggggggaaagtggggggcgggggccccaaaggggggggcgcttttttctccccccccttgtggcccctggtttttgggggg

SEQ ID NO: 35858 - DNA, 640 bp, Zea mays
  misc_feature: Ceres CLONE 1418168-F
  misc_feature: Encodes the peptide sequence at SEQ ID NO. 35859
ggagctccccgcggtggcggccgctctagaactagtggatcccccgggctgcaggaattcgcacgagaccattacctagaacatcctaatcgaaaaacacccatgtccacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggagaagttcgcggccgagaggggtgccttcaccgccgtgctctctggcggatccctcatcgaggcactcaggaagctgacggagccgccgtacctggattcagtggactgggagcagtggcacgtcttctgggtggatgaaagggtcgtgccccaggaccatgtggatagcaactacaagctcgcctatgatgggtttctcctccaggtgcccaattcctccctggacaagtttatgccataaattgatg

SEQ ID NO: 35859 - protein, 176 aa, Zea mays
  misc_feature: Ceres CLONE 1418168-F
  misc_feature: SWISSPROT Homolog: EC 3.1.1.31 6-phosphogluconolactonase
MSTSVSAAAVAALVPPLTGRRSPPASRVPQICRRRIRSKPRIFSSSPSFPIVPAAAMATGGAAPTASDAGSKKKLLIFDSEEDLAVSLAKYTAELSEKFAAERGAFTAVLSGGSLIEALRKLTEPPYLDSVDWEQWHVFWVDERVVPQDHVDSNYKLAYDGFLLQVPNSSLDKFMP

SEQ ID NO: 35860 - DNA, 663 bp, Zea mays
  misc_feature: Ceres CLONE 1418172-F
  misc_feature: Translation starting site: 183
ggagctccccgcggtggcggccgctctagaactagtggatcccccgggctgcaggaattcgcacgagaccattacctagaacatcctaatcgaaaagcacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcacccttacgctgctatgctttgctgctcaagacgtcgcacagcgctgcaaggagcttggcattactgcactgcacattaagcttcgcgccaccggaggcaacaagaccaagacccctggacctggtgcccattctgccctcagggcgcttgctcgttccgggatgaaaatcggacgcattgaaggacgttacccccggtccccactggacagcactccgcataaagggcggtaaggaggggaaaagaaggctgtaaaggcctcctcggtctggcg

SEQ ID NO: 35861 - DNA, 615 bp, Zea mays
  misc_feature: Ceres CLONE 1418175-F
  misc_feature: Encodes the peptide sequence at SEQ ID NO. 35862
ggatcccccgggctgcaggaattcgcacgagaccattacctagaacatcctaatcgaaaaatattggccgtgcgtccgtggctttgcatctgcaaccccgcccgatcaatcttcctcgttccgccgctccctcgcctccggcagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaaagcctgcttccgggaactcctatcctaggaaaggatgtcgtcatctgcacgtttccaagtgatccgactcttgcgatggggaagcctgtcaattgtggcccttgtggaaacttgccatcgtagggcattgttgccctccttcttttcccaaactcggggaaaagtccatttcccccggggaaaacgccttgtttcaaaaccccaactttgaaagggtttctttgttggttgctgaaacttggtctccccccttgggtcttttggaaggtccccttgtgggaaatgtgcccccaaggggtttctccaccgcaaaaagaaa

SEQ ID NO: 35862 - protein, 39 aa, Zea mays
  misc_feature: Ceres CLONE 1418175-F
MALSATLRISLSVAFFGVLAFVLGVIAENKKACFRELLS

SEQ ID NO: 35863 - DNA, 813 bp, Zea mays
  misc_feature: Ceres CLONE 1418176-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
nnnnnnnnnnnnnnnnnnnnnggggggttggggnnnnggggnatcaattnngttggagttggagctccacgaggtggcggccgctctataactagtggatcccccgggctgcaggaattcgcacgagaccattacctagaacatcctaatcgaaaaaactacggccaccagtcttctcccactcccagtgccagccgccttgcgcttgccctctctgagacgactgggagcggcgacgccgccgctgtcctacgtcaggtgtcgaaggcttcgccggggaagagcgctcaccagattatccatctactacattcacccctggtggaggaggagaacaaggtaagcgaaaatgctacggcggagcatactgtagcgtcgggagtatctgttactccaagagcctcgagggcccccagcggttggctgttctgagaaaaaacgccgtgatccggggggcgcctcgtaggaaggaaaagccccattcccccaaccgagtctccgcaatctgaggagtaccgacctggcggaagggaaaattcgaccctcgaaggaacccatgaagccgtccagggttcccccaatgaaccaattcgtttgaaaaagcgagataccgcttatcttggccacccattttccgggaagcccccaaagaataattaattggaacccactttcctcccccaatcccctaggtggggggccccctaaaaatcaagtgttggctatagaggaaccttcaaaggggttgtttctttaccccagaacttccacaaaaagaaattgaaatcccgtgggggtggaaacaaaagttcc

SEQ ID NO: 35864 - DNA, 689 bp, Zea mays
  misc_feature: Ceres CLONE 1418180-F
  misc_feature: Encodes the peptide sequence at SEQ ID NO. 35865
  misc_feature (296)..(296): n is a, c, t, g, unknown, or other
aaagctggagctccccgcggtggcggccgctctagaactagtggatcccccgggctgcaggaattcgcacgagaccattacctagaacatcctaatcgaaaaaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcncctcccgcctcatcgcctccaacaccgccaagctgccctccttctatgatgaaagaaggatgtgggtgtttgacgaaaatactgcctagcgggggggaacctatctgagtcccattaacgaacagaatggaaactgcaaatacttggccgggtataaagctttggaaacaattgttatttgccgaaccctgaacttgaagaggcgcactccaaaaaaccccgaatattgctggttatttggtgacgccccccatcattttgggggaaggggattttgtaaaacacctttgggagggagagacttaacacccccgcgagctctgagggcttttctccccctcattcaagggggattgggagaggtccaataaaggaaaacggcgcccttctatg

SEQ ID NO: 35865 - protein, 52 aa, Zea mays
  misc_feature: Ceres CLONE 1418180-F
  misc_feature: SWISSPROT Homolog: EC 1.1.1.8 Glycerol-3-phosphate dehydrogenase (NAD(+))
  misc_feature (24)..(24): Xaa is any aa, unknown, or other
MEMENGHAKYRVAVIGSGNWGSVXSRLIASNTAKLPSFYDERRMWVFDENTA

SEQ ID NO: 35866 - DNA, 647 bp, Zea mays
  misc_feature: Ceres CLONE 1418183-F
  misc_feature (200)..(200): n is a, c, t, g, unknown, or other
  misc_feature (203)..(203): n is a, c, t, g, unknown, or other
ggatcccccgggctgcaggaattcgcacgagaccattacctagaacatcctaatcgaaaacaccaaaggtaccttgcaatcacaacgaacagaagctctcgatctcaccgacaccgaggaagaagagatcaatggcgtccgagcagggagtcgtgatcgcgtgccacagcaaggctgagttcgacgcccacatgaccaanggnccaggaagccggcaagctggtggtcatccacttcactgccgcctggtgcggtccatgccccgccatcgcccccatgttcgtccaaaccgccaagaagttcactcgggtccgcttccctgaagggggacctggaacaaattgaaagaaatcccccgcgggcttacaaagggcaaagggcgaatcccaacctttccctttcacaaaaaaaaggaaaacgggccccacaccttccggggtggccaaaaaaaaaaaaaacctctggccacaaaataaaaaaaatagtccccccctgggccctggggttttgcggttgtcgcaaaaaaaaaacccccccccccccccccaaaaagggcccccccccgatggggctggaaaaggggtttcctaaaacaacctccgggtttttcgcttgggggggcacttttatacaaaaaaaatatcttt

SEQ ID NO: 35867 - DNA, 696 bp, Zea mays
  misc_feature: Ceres CLONE 1418184-F
  misc_feature: Encodes the peptide sequence at SEQ ID NO. 35868
  misc_feature (243)..(243): n is a, c, t, g, unknown, or other
  misc_feature (267)..(267): n is a, c, t, g, unknown, or other
  misc_feature (270)..(270): n is a, c, t, g, unknown, or other
  misc_feature (271)..(271): n is a, c, t, g, unknown, or other
  misc_feature (358)..(358): n is a, c, t, g, unknown, or other
ggagctccccgcggtggcggccgctctagaactagtggatcccccgggctgcaggaattcgcacgagaccattacctagaacatcctaacgaaaaaatcaattctccagaccctccccggcaaccgcgtccggccgtccgcttccgtctccttggataaccacgacgcccgccggcaagcgaaagcgaagcgagccaacccagccatggagaaggcgatcgatcggcagcgggtcctcctggngcactttctcccctccctctccgncgnnctcctcgaagctcagcttgcggcgtcggcgtgcgcgggcggggacagcgccccctaacaaaggtcctcttcctcggggaagatgtcntcgtcttcccttgctaagggaggccaaatttgcaggccaacgggagagggtttcagggaccccttcccaaagaccccccctacgtgttgtttccaagggggttttgggaaaaacctaaaaaaacccccctagaaacggggaaaatccccttgtggaaaggggttttgcccctttctcccccggggaaaaaaaaaggaaagagaggcgcctttttttttgtgaaatccccaaaaaacccccccttttaaaaaaaacttccccccccccttttttttttttggggtgtaacggggagaaaaaatatacccccccccctcaataagagggggggttttaaa

SEQ ID NO: 35868 - protein, 40 aa, Zea mays
  misc_feature: Ceres CLONE 1418184-F
  misc_feature (13)..(13): Xaa is any aa, unknown, or other
  misc_feature (21)..(21): Xaa is any aa, unknown, or other
  misc_feature (22)..(22): Xaa is any aa, unknown, or other
MEKAIDRQRVLLXHFLPSLSXXLLEAQLAASACAGGDSAP

SEQ ID NO: 35869 - DNA, 639 bp, Zea mays
  misc_feature: Ceres CLONE 1418188-F
  misc_feature: Encodes the peptide sequence at SEQ ID NO. 35870
acccgcggtggcggccgctctagaactagtggatcccccgggctgcaggaattcgcacgagaccattacctagaacatcctaatcgaaaatgctggagttggaatgagggcatcagctgcttacatctacattagaggtgaatacgtgaatgagcgtctcaaccttgagaaagctcggcaggaagcgtatgcagctggacttctgggtaagaatgcttgtggctctggttatgattttgatgtgcatattcattttggtgctggtgcgtacatctgtggtgaagagaccgccctactagagagccttgaagggaagcagggcaaacctaggctgaagccacctttcccagccaatgctgggctctacggctgccccacaactgtgactaatgtagaaactgtggctgtatccccacaattcttaggcgcggtccagaatggtttgcaagctttgggcgcaagaacaactctgggacccagctctatggcatctcagggcatgtgaacaaaccttgcaccgtggaagaggaaatgagcatacctctgaaggagttgctcgagaggcactggtgaaagtgtgagaaggggaatgggacaacctgcttggggtaatttcctggggttcatcctttccccttt

SEQ ID NO: 35870 - protein, 133 aa, Zea mays
  misc_feature: Ceres CLONE 1418188-F
  misc_feature (1)..(125): Pfam Name: Complex1_51K Pfam Description: Respiratory-chain NADH dehydrogenase 51 Kd subunit
  misc_feature: SWISSPROT Homolog: EC 1.6.99.5 NADH dehydrogenase (quinone)
MRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPQFLGAVQNGLQALGARTTLGPSSMASQGM

SEQ ID NO: 35871 - DNA, 652 bp, Zea mays
  misc_feature: Ceres CLONE 1418198-F
  misc_feature: Encodes the peptide sequence at SEQ ID NO. 35872
ggatcccccgggctgcaggaattcgcacgagaccattacctagaacatcctaatcgaaaagccccagattttcccgcgttcgtggtttaccattctctagttctccgttccccaaccccaacctaccatacttgcatacctaggttcaggtaccgttgactgcgcatcaatataatcctcctgtggacggagcgccaatttcccgcccatcaagccctatgggctccactaggtaactagatataccttctctctttcctgttaccggggccgttgttgccgtcgctgtactgaacctgatgtcttccggcacaacatactccgtcagacctcataacctccccggcgccgctaacggatctgcttcctagggcccgctggctcagtcccccttccatcctgtcaaaagggaaggatatatttcccgtgacgacctacttttggggatagttctcccttttgctggaagcatcttaagatccctgacccgcctgttggaagcacgccttgggtacgcctatctggaaacaatcctaagaaattgggctccaattgcctttccccacaacgttgctacccaaggaacaacctttcctcgggagcaaaaaaattctctcgaatagccaataatcctttttgacaagaataattt

SEQ ID NO: 35872 - protein, 52 aa, Zea mays
  misc_feature: Ceres CLONE 1418198-F
GSPGLQEFARDHYLEHPNRKAPDFPAFVVYHSLVLRSPTPTYHTCIPRFRYR

SEQ ID NO: 35873 - DNA, 657 bp, Zea mays
  misc_feature: Ceres CLONE 1418199-F
  misc_feature: Encodes the peptide sequence at SEQ ID NO. 35874
  misc_feature (467)..(467): n is a, c, t, g, unknown, or other
ggagctccccgcggtggcggccgctctagaactagtggatcccccgggctgcaggaattcgcacgagaccattacctagaacatcctaatcgaaaaaaattgaccgccattgtgcaaaccagaaccccttcgccattttcaccaactccctccgatcccggccatggcgggggaggactgccgctccggcgcggaaatggacgcgctcgtacgacgcttgaagctccaccggccgtccccatccccctacgaccccgatccggccgcggcccccgtccccgccaccgccggcgacggcgagctgttccggccgcggagagctgccgtgcttgtctgcctcttccggggagacggcagcgagctccgcgtcatcctcactaagcgctcgtcctccctctccacccactccggtgaagtttcattgccaggaggaaaggtcgagggaggtgatgctgatgatgtagcancagcgttaagagagtcaaaagaggagattggacttgatccagctctggtaactgtgggtgcctctcttgaacacttcttgtcaagcatcttctggtagttgttcctggttgtggcatactgttagacagacaagcatttaaacctgctcttaatattgctgaggtagaacaaatatttgatgtccccctg

SEQ ID NO: 35874 - protein, 133 aa, Zea mays
  misc_feature: Ceres CLONE 1418199-F
  misc_feature (102)..(102): Xaa is any aa, unknown, or other
MAGEDCRSGAEMDALVRRLKLHRPSPSPYDPDPAAAPVPATAGDGELFRPRRAAVLVCLFRGDGSELRVILTKRSSSLSTHSGEVSLPGGKVEGGDADDVAXALRESKEEIGLDPALVTVGASLEHFLSSIFW

SEQ ID NO: 35875 - DNA, 668 bp, Zea mays
  misc_feature: Ceres CLONE 1418200-F
  misc_feature: Encodes the peptide sequence at SEQ ID NO. 35876
tggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctggtgggcgcgacatctccggcgggcacgtgaaccctggcgtgaccttcggcgccttcgtgggcggcaacatcaccctgtttcggggggctcctgtactgggtgggcgcagctgcctggggtccaccgtgggggtggttccctgctccgctttctccgacggggggggcaggccaccgggcacctttcggggctgaacggcccttggtccgtgtgggaaggcccctgggggcctggaaaatccgggatgacc

SEQ ID NO: 35876 - protein, 138 aa, Zea mays
  misc_feature: Ceres CLONE 1418200-F
  misc_feature (13)..(139): Pfam Name: MIP Pfam Description: Major intrinsic protein
MPINRIALGSHQEVYHPGALKAAFAEFISTLIFVFAGQGSGMAFSKLTGGGPTTPAGLIAAAVAHAFALFVAVSGGRDISGGHVNPGVTFGAFVGGNITLFRGAPVLGGRSCLGSTVGVVPCSAFSDGGGRPPGTFRG

SEQ ID NO: 35877 - DNA, 658 bp, Zea mays
  misc_feature: Ceres CLONE 1418201-F
cccgcggtggcggccgctctagaatagtggatcccccgggctgcaggaattcgcacgagaccattacctagaacatcataatcgaaaatttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcgtcggcgcggggcgcctcgccgacgccgcctcctccgggcgcgcgtccccccgccggcgcaacttttcaactggccgggcgcccacagccgcagctcttcccgcccggtccgggcgcgtttccaccaaccgtcggcgcggggcgatgcgccattgtccccagcgggcgcaaggacaagggccacttgttccaattccaccgggcacccatggggagcaggcccttgccattggacaaactccaaccccgggcccaaaaaaaaaaagggggcccgggggcaaaggcccccaagggtaaactccggggggcccaacggggttgttttttttttcccgggtttttacggggggaaaaaaacaaacccaaaaatttgtttt

SEQ ID NO: 35878 - DNA, 664 bp, Zea mays
  misc_feature: Ceres CLONE 1418203-F
  misc_feature: Translation starting site: 220
  misc_feature (664)..(664): n is a, c, t, g, unknown, or other
ggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaggaagctccagactggagtcaataagcttgcagacctagttgggagttacactcgggaccgaagggaaaggaaatgtcgttttggagagcaagtacggctctcccaagattgttaacgatggccgttacagttgcaagaaaaggttgagctgggaggaccctgtgggaaaaacttggaacctaaatttgggtcaggcaagcctgcagcctaaaacccaacgatttttggtgggaaaaggggaacaccccccctcctgggggtccctttgccccacggggcctaaattggctgaggggttgttn

SEQ ID NO: 35879 - DNA, 666 bp, Zea mays
  misc_feature: Ceres CLONE 1418205-F
  misc_feature: Encodes the peptide sequence at SEQ ID NO. 35880
tggagctccccgcggtggcggccgctctagaactagtggatcccccgggctgcaggaattcgcacgagaccattacctagaacatcctaatcgaaaacttctagacagcgacgccgtggggagccgccgccgcgcgctccgctcctccctgcacctcatccccttcccctgctccccctcacacgacctgcggcggtgcgaggaccggccttggcaccactcaccagcgcccccggtgcctggagcagtgcagggaggaggagcgggagaagcggcaagagcggagcaggcgcagtgcagggaggaggagcgggagaagcggcaagagcggagcaggcacgaggccgacgactgcagcggcgagggctcgtcggaggatgagcgcgagcgcgagcaggagaaggaggagaagcagaaggacccggcggccgtacatgttcttccgtcgcagcttccgtcgcgtggtccggagcgagcaggggtccctgaggggctcctttggcatcacaggatccccggaaggatcccagaccaatccctggccacggaaaccccaatcaaaattgtcccctgcgggatttttttttccactctttgggggaaccacgctttcccgggcctcaccggcggggggagctccggtggatttcccctcccccccccacg

SEQ ID NO: 35880 - protein, 96 aa, Zea mays
  misc_feature: Ceres CLONE 1418205-F
MSASASRRRRRSRRTRRPYMFFRRSFRRVVRSEQGSLRGSFGITGSPEGSQTNPWPRKPQSKLSPAGFFFPLFGGTTLSRASPAGGAPVDFPSPPH

SEQ ID NO: 35881 - DNA, 654 bp, Zea mays
  misc_feature: Ceres CLONE 1418212-F
  misc_feature (371)..(371): n is a, c, t, g, unknown, or other
  misc_feature (412)..(412): n is a, c, t, g, unknown, or other
ggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacatacacacgtccagctagctgcactgcaccaatggccgccgtcgaggtccaggtcccgactgccgctcccgtcgaggaggctgcccagctgggcgccgcctccgccgtcgagaccccgacgaggagaccgctgctccggcggtggagaccgaggtcgtcgtcgctaangagccggagccggtggaggccgagactgagactgagaccanggaggccgaaggccttgctgagccgaccgaggcagagcccaaggaaacagaacccggagcccgcccccgccggcagcagaaaccgaagtcaaggaaacaaagaccgaagccccccccgcccgcagcaaaaaacgaggctgctgcctgcccccgtcaaggctgctgaccccgaaaatagcccccaaaaccaactatagggacgctgtggacactctcaccactgcgaacacgatgcctccgtg

SEQ ID NO: 35882 - DNA, 649 bp, Zea mays
  misc_feature: Ceres CLONE 1418268-F
  misc_feature: Encodes the peptide sequence at SEQ ID NO. 35883
ggagctccccgcggtggcggccgctctagaactagtggatcccccgggctgcaggaattcgcacgagaccattacctagaacatcctaatcgaaaaatcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgactatcgctcacggcggtgtgctccccaatatcaaccccttttctgctgccccagaagacggcgggagaaggcgtccaggtgtgggggagcaagggaggcaaaatcgcccaagaagggccgccaagt

SEQ ID NO: 35883 - protein, 156 aa, Zea mays
  misc_feature: Ceres CLONE 1418268-F
  misc_feature (31)..(104): Pfam Name: Histone Pfam Description: Core histone H2A/H2B/H3/H4
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPFSAAPEDGGRRRPGVGEQGRQNRPRRAAK

SEQ ID NO: 35884 - DNA, 636 bp, Zea mays
  misc_feature: Ceres CLONE 1418278-F
  misc_feature: Translation starting site: 191
  misc_feature: SWISSPROT Homolog: EC 1.3.5.1 Succinate dehydrogenase (ubiquinone)
  misc_feature (397)..(397): n is a, c, t, g, unknown, or other
  misc_feature (459)..(459): n is a, c, t, g, unknown, or other
ggagctccccgcggtggcggccgctctagaactagtggatcccccgggctgcaggaattcgcacgagaccattacctagaacatcctaatcgaaaaacgcgcgcccaaaggcccccaaggccccaaccccaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcaaggactaccangtggacctgtccgactgcgggccgatggtgctggacgcgctgctccagatcagaacgagcangacccgtcgctcaccttccgccgcagctggcgggagggcatctgcggaagctgcgccattgacatcgacgggggaaaacggcctcgcctggctcaccaaaactccgggggcctcctcccggtcaaggtctccccgcttcccccaatggtcgtcctcaagggacttgggggggaactt

SEQ ID NO: 35885 - DNA, 697 bp, Zea mays
  misc_feature: Ceres CLONE 1418285-F
  misc_feature: Encodes the peptide sequence at SEQ ID NO. 35886
acccgcggtggcggccgctctagaactagtggatcccccgggctgcaggaattcgcacgagaccattacctagaacatcctaatcgaaaaaccccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctctttgtctggttgcatacaagaacgtcatttggagcccgccccgcggcctcatggcgcatcatctcctccatcgagcagaagggaggagggcccaaggcaatgaaggacccaattaccccccctccaaggattaccgggggcaagaattgaaacctggagtccgaccaaaaattcgggggatgccatcccccaaagcgggcttgagaaccctctttgggggccgtctttcccctggcccccggaattccaaggggccttttattctctaaagaggaaagggggggttttaccaaccaaaacccctttgggggaaattccaaaacacgggggccctaaaaaaaaaaaaggcccccccccctaaaaaa

SEQ ID NO: 35886 - protein, 99 aa, Zea mays
  misc_feature: Ceres CLONE 1418285-F
MASAELSREENVYMAKLAEQAERYEEMVEFMEKVAKTVDSEELTVEERNLFVWLHTRTSFGARPAASWRIISSIEQKGGGPKAMKDPITPPPRITGGKN

SEQ ID NO: 35887 - DNA, 611 bp, Zea mays
  misc_feature: Ceres CLONE 1418286-F
  misc_feature: Encodes the peptide sequence at SEQ ID NO. 35888
agtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatccccgtcaacttcatctggaacgggaacttctcggggccccaacgggggcgggaataaccgaattcgtctccgtccttaaagggggggggccccggccggcggccaaccggaaaccctccggggccccctgggtttcagaaaggccccaaattacaaacccccaccccaaggggggccgttccccgggcgtggcgcctcgggctcccacaccccttaaaacggaaaattgcccccctctgcgcagggcccccttaaaaaaaaaagggacccgtctccccccc

SEQ ID NO: 35888 - protein, 70 aa, Zea mays
  misc_feature: Ceres CLONE 1418286-F
MACYNTASLAATLLAFALTFQACLAGRRLTALVQEPAITMRYHKGALLSGPIPVNFIWNGNFSGPQRGRE

SEQ ID NO: 35889 - DNA, 846 bp, Zea mays
  misc_feature: Ceres CLONE 1418289-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
nnnnnnnccccnnnnnnnnnnnttttttttttgggnnncgantttgtccctggcacaaaataggactccccgcggtggcggccgctctataatagtggatcccccgggctgcaggaattcgcacgagaccattacctagaacatcctaatcgaaaaaaacgatggacgccagcccatgggccaacgatcctccgtggaccgacttcctaaccgcacgaacctccgagacggagcgtggcgcccgcctcggcgcctccgccctccgtcggcggcgcatggtgaagcataaaaggtggcgtactcgtacctctcgcacacgcccccttcgcccttcttgcaacaaatctggcttccctcccccttggcccttgctgccttttgccccccttgcttccccggtggccaacctccggggtccgcggcccctttgcccggcgccccaacgggttgctttctgttcccgccacccgaaggggggaagccttggcttcctcctactttaagcccggggggcctggattcagggaaccctacccggcctcggggggaaaacccctcctttcccacccggccgcctcttaattggttagggaaggtgtcacacattgtctttttccccctcccccttctgcgggggttattatctttccttatcaaaaggggagagactttatatggtagggagaaaaaaaaaccccatcacatatctaaacaaaaataaaaaatgttttcattattaaactctcctgtaataaaaaacaccctccccaccatatccatttgtttttgtgttgtttattaatattatctcctcgagtgtatttttttatttgtgtgtctaccccg

SEQ ID NO: 35890 - DNA, 660 bp, Zea mays
  misc_feature: Ceres CLONE 1418293-F
  misc_feature: Encodes the peptide sequence at SEQ ID NO. 35891
tccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgccgtggacggcggccgggcaggggaggaagaggctgctggtgggggtcgggccgctgggacccggaaacgtggggcgccgacgggaccccggggctccgtct

SEQ ID NO: 35891 - protein, 155 aa, Zea mays
  misc_feature: Ceres CLONE 1418293-F
  misc_feature (3)..(50): Pfam Name: F-box Pfam Description: F-box domain
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPPPGPSQSLPLFCQVAAAVDGGRAGEEEAAGGGRAAGTRKRGAPTGPRGSV

SEQ ID NO: 35892 - DNA, 687 bp, Zea mays
  misc_feature: Ceres CLONE 1418294-F
  misc_feature: Encodes the peptide sequence at SEQ ID NO. 35893
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (47)..(47): n is a, c, t, g, unknown, or other
  misc_feature (49)..(49): n is a, c, t, g, unknown, or other
  misc_feature (53)..(53): n is a, c, t, g, unknown, or other
  misc_feature (55)..(55): n is a, c, t, g, unknown, or other
  misc_feature (63)..(63): n is a, c, t, g, unknown, or other
  misc_feature (687)..(687): n is a, c, t, g, unknown, or other
nnnnnnccccccnnnnnnnnnnnnnnncccctccacccgcgcgtccncncctntnggggaaantaataaaaatggaactcaccgcggtggcggccgctctagaactagtggatcccccgggctgcaggaattcgcacgagaccattacctagaacatcctaatcgaaaaactccgatcctgccctctaataacagcagcagcagccgccatggaaggcagcagcaagaagctccagccgttcctcctcacgctgctgctggtgctctccaccgccgtgacgcccatcctctcgctgtcagtgccagacgacgaggtagctctgcgactgctgacaaacccaaggcgcccaagccgtcgcacccgcccaagaccaagccctcccacccgtcgccgaagcccaagaaccccaagccacccaagggcggcaccgggtacccggcgccagggcaccaaccgcccaagagcccctcctaccccccggtcgtcggccctcccaagggccccgtcacgcgcccgccagtcacgcgtccgccggtcgtcggtcctcccaaagggccccgtcacgcgccccgccggtcacgcgtcccgccggttggccggaccacccggtgacctaacccgcccaaatcaccgggcccctcccgaaaaacgccccgccttgttggtccgaaccccccggggagaan

SEQ ID NO: 35893 - protein, 201 aa, Zea mays
  misc_feature: Ceres CLONE 1418294-F
  misc_feature (3)..(3): Xaa is any aa, unknown, or other
  misc_feature (4)..(4): Xaa is any aa, unknown, or other
  misc_feature (5)..(5): Xaa is any aa, unknown, or other
  misc_feature (6)..(6): Xaa is any aa, unknown, or other
  misc_feature (7)..(7): Xaa is any aa, unknown, or other
  misc_feature (14)..(14): Xaa is any aa, unknown, or other
  misc_feature (16)..(16): Xaa is any aa, unknown, or other
  misc_feature (19)..(19): Xaa is any aa, unknown, or other
PPXXXXXPSTRASXPXGEXNKNGTHRGGGRSRTSGSPGLQEFARDHYLEHPNRKTPILPSNNSSSSRHGRQQQEAPAVPPHAAAGALHRRDAHPLAVSARRRGSSATADKPKAPKPSHPPKTKPSHPSPKPKNPKPPKGGTGYPAPGHQPPKSPSYPPVVGPPKGPVTRPPVTRPPVVGPPKGPRHAPRRSRVPPVGRTTR

SEQ ID NO: 35894 - DNA, 611 bp, Zea mays
  misc_feature: Ceres CLONE 1418295-F
  misc_feature: Encodes the peptide sequence at SEQ ID NO. 35895
  misc_feature (170)..(170): n is a, c, t, g, unknown, or other
ggatcccccgggctgcaggaattcgcacgagaccattacctagaacatcctaatcgaaaaactcccaattggaagggcagctaataaggtaaggggcgacgaaaatggctccaacgaccgccaccaaggacgacagtggctacggcgacgagcgccggcgcgagctgcangcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgacccacgagtgccggaggagctgatgggccgcatgctccccggggtgcgccagttcaacgaggggccccgtgaaggcgaagcaagcgctctactcgagggacctcgctccgaacctgcgctttcgctccaactttcaacctcttcaaggctgctgccggccgaatggggccgacacgctctttctgggaggggggctccca

SEQ ID NO: 35895 - protein, 109 aa, Zea mays
  misc_feature: Ceres CLONE 1418295-F
  misc_feature: SWISSPROT Homolog: EC 1.14.11.20 Desacetoxyvindoline 4-hydroxylase
  misc_feature (22)..(22): Xaa is any aa, unknown, or other
MAPTTATKDDSGYGDERRRELXAFDDTKLGVKGLVDSGVKSIPSIFHHPPEALSDIISPAPLPPSPPSGAAIPVVDLSVTRREDLVEQVRHAAGTVGFFWLVTHECRRS

SEQ ID NO: 35896 - DNA, 742 bp, Zea mays
  misc_feature: Ceres CLONE 1418297-F
  misc_feature: Encodes the peptide sequence at SEQ ID NO. 35897
  misc_feature (42)..(42): n is a, c, t, g, unknown, or other
  misc_feature (46)..(46): n is a, c, t, g, unknown, or other
ccccgcgcgccgtgggggccgggggcccggcggggtttggtnggcngtttttaaagtgggactccacgcggtggcggccgctctagaactagtggatcccccgggctgcaggaattcgcacgagaccattacctagaacatcctaatcgaaaagaatctatctttttctcctcctgccgtacgtccgttccagcttgcaaagcgctcgcgagctgctgccatggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccggggcctctggggccgccgccgaggccgaggctggctaccgggtgctcaccccgacgccgcacctctccatgggccccgcggagcaactgcctcgttggccggcggcaatacgctaaaatccggctccaaaggagggtggaacaaggaacgaactttccccgcaaggtggggggggggggcccttcgcccctccacccttcccgggggcccgggtgggaacgccgtggggtcaaccgcgcccttaaacgaacccactggtcggatatggtcctaa

SEQ ID NO: 35897 - protein, 173 aa, Zea mays
  misc_feature: Ceres CLONE 1418297-F
  misc_feature: SWISSPROT Homolog: EC 1.5.3.1 Sarcosine oxidase
MAGAGAPAVPQAGRPAPNFDVIVVGAGIMGSCTAHAAASRGARVLLLERFDLLHPLGSSHGDSRIIRDAYAQPRYLRMVRLARGLWGRRRGRGWLPGAHPDAAPLHGPRGATASLAGGNTLKSGSKGGWNKERTFPARWGGGALRPSTLPGGPGGNAVGSTAPLNEPTGRIWS

SEQ ID NO: 35898 - DNA, 656 bp, Zea mays
  misc_feature: Ceres CLONE 1418305-F
  misc_feature: Encodes the peptide sequence at SEQ ID NO. 35899
acccgcggtggcggccgctctagaactagtggatcccccgggctgcaggaattcgcacgagaccattacctagaacatcctaatcgagaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatccctggcggcaccgtgatcgcgctcacggtggccacccccgtgctggtgatcttcagcccggtgctggtgccggccgccatcgcgctggcgctcatgggcgcccgggtcgtcacctccggcggcctcggcgtccctgcgctgtccgtgttctcctggatgtacaagtacctgaccggcaagcacccgcgggcccccaccagctggaccacgccaggcaagggctgcgtccaaggcccggcaactcaaggatgcagcacagcacggcatcgaccaggcgcaggggtcctgaaaaaaaac

SEQ ID NO: 35899 - protein, 159 aa, Zea mays
  misc_feature: Ceres CLONE 1418305-F
  misc_feature (36)..(148): Pfam Name: Oleosin Pfam Description: Oleosin
MADHHRGATGGGGGYGDLQRGGGMHGEAQQQQKQGAMMTALKAATAATFGGSMLVLSGLIPGGTVIALTVATPVLVIFSPVLVPAAIALALMGARVVTSGGLGVPALSVFSWMYKYLTGKHPRAPTSWTTPGKGCVQGPATQGCSTARHRPGAGVLKKN

SEQ ID NO: 35900 - DNA, 816 bp, Zea mays
  misc_feature: Ceres CLONE 1418307-F
  misc_feature (1)..(1): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (51)..(51): n is a, c, t, g, unknown, or other
  misc_feature (52)..(52): n is a, c, t, g, unknown, or other
nccccccccggnaanngggaaacaagnnnngagnnnntanncaccttacannttaaaagtgggactcaccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagccctttcatgtgctccggcggacggtgtttgtcccgttccgggcgctctgccccgccaagcctggtttggctgtgccgcccaagctgcctggctttccctacgggggggttcccagtccccggaacaggaataaggtggcagggtggatttggccctggcccgccccgaacatcctccccaccccgcctttgcccgaaaggcggcccaaggatccttcccggttcgccaagggggccccgagtgcccgttccaaccaattcccttataggctcccgtccgtggccctcccacccaacaaagacccggggaaagggcggcggggcccttttgtaaaactttgaccacagacagccccatatccacacctctcggggggtgccgggaggatttccctataacccggggccccgccccctg

SEQ ID NO: 35901 - DNA, 770 bp, Zea mays
  misc_feature: Ceres CLONE 1418308-F
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (770)..(770): n is a, c, t, g, unknown, or other
gcccgtccctcccactttctttacataagggggaangggggnnnnnnnnncnnnncaaaactggagctccccgcggtggcggccgctctagactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacataccttttatcggcccttgttgtttcaacaatcgccaggccctatcttccccccccactcattgggacaaaccatccggggcacaacagctgccagcaactcgaggtacccttctaataaaccaagaagcttctggaaaaaccttttctcccctactcctcaggaaacaaacaattttctttccacttccagggcgacttggtcaaccactaaaacccccgggctgccttaatttgggcaacacaccaccaatttaacccatttttagaccaggagatggtaaaactgcccaaacctgtcccaggcatacgaggcaacgtttctgtttccaattttttaaccccan

SEQ ID NO: 35902 - DNA, 601 bp, Zea mays
  misc_feature: Ceres CLONE 1418309-F
  misc_feature: Encodes the peptide sequence at SEQ ID NO. 35903
  misc_feature (537)..(537): n is a, c, t, g, unknown, or other
ggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgctgggccaagccagagcctgcctctgttctgccaggtggccgccgccgtgacggcnggccggcaggggaagagaggctgctggtggtggtcggcggctgggacccggaaacgtgggcgcg

SEQ ID NO: 35903 - protein, 122 aa, Zea mays
  misc_feature: Ceres CLONE 1418309-F
  misc_feature (3)..(50): Pfam Name: F-box Pfam Description: F-box domain
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPPLGQARACLCSARWPPP

SEQ ID NO: 35904 - DNA, 652 bp, Zea mays
  misc_feature: Ceres CLONE 1418314-F
  misc_feature: Encodes the peptide sequence at SEQ ID NO. 35905
  misc_feature (652)..(652): n is a, c, t, g, unknown, or other
cgcggtggcggccgctctagaactagtggatcccccgggctgcaggaattcgcacgagaccattacctagaacatcctaatcgaaaaacgttgttcctcccgaccctcgccgtccctcccgccgcgacccgccctcctcctcccgaccacgccgcccagcccgtgtaccactccctcccagcctcgccctcccacgccgtccctcccgccgtgacccttcctcctcctcccgacctcgccgcctagcccgtgtcgccgccgtcgcccgtgccactctgctgctgcgaccacgacaatggggatgtggaatttggtgtgcgtcaccgacgcatcagcgtacatcgcgtcctggatcgtcaggctcctcctcgaccgtggctacaccgtccgcgccaccgtgcgagacacagcctttggaaatgtagagcccacctcagttgatctattcaagaacttccattatagcaaaaacaatggatttaccgagtttgtacagaaagcaattgatgatatggaaggcatcatgagtgaaccagtacaagatggacatgaaccaaagttagcaaatgaagttgtttctcaagttgtcaaaatcaactactttttcttcgcggttgcaggtgttttgttcgggcctcccaagagtaccttn

SEQ ID NO: 35905 - protein, 118 aa, Zea mays
  misc_feature: Ceres CLONE 1418314-F
  misc_feature: SWISSPROT Homolog: EC 1.1.1.219 Dihydrokaempferol 4-reductase
MGMWNLVCVTDASAYIASWIVRLLLDRGYTVRATVRDTAFGNVEPTSVDLFKNFHYSKNNGFTEFVQKAIDDMEGIMSEPVQDGHEPKLANEVVSQVVKINYFFFAVAGVLFGPPKST

SEQ ID NO: 35906 - DNA, 659 bp, Zea mays
  misc_feature: Ceres CLONE 1418315-F
  misc_feature: Encodes the peptide sequence at SEQ ID NO. 35907
  misc_feature (534)..(534): n is a, c, t, g, unknown, or other
gctctagaactagtggatcccccgggctgcaggaattcgcacgagacctttacctagaacatcctaatcgaaaaatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggaacgtggggcttctttctggctggtgaaccacggcgtggcaaaggagctgatgggcggcatgctccgcggggtgcgccagttccaacgaggggccccgtggaaggcaaacaggcgctctactccaaggacctggnctcgcaacctgggcttccccctccactttcaacctctttcaaggccgctgccggccgaatgggccccaaccccctcctccggcggagggggctcccaaacccccccccccgcggggaagaacgtt

SEQ ID NO: 35907 - protein, 102 aa, Zea mays
  misc_feature: Ceres CLONE 1418315-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPSSPPSGAAIPVVDLSVTRREDLVEQVRHAAGNVGLLSGW

SEQ ID NO: 35908 - DNA, 658 bp, Zea mays
  misc_feature: Ceres CLONE 1418356-F
ggagctccccgcggtggcggccgctctagaactagtggatcccccgggctgcaggaattcgcacgagaccattacctagaacatcctaatcgaaaactgccgagttttccttccccacctccgcgccccacccgtcgccgaatcagagtcccgctcgggttcttcctgtgccagagctctagatctatctcctggtcgggttggatggatccattcgggcgctgcgtccagcggaattctcgtcaagtgctgtaacatccaatcgcatgccgaacgaggtgggagcagggtctgttcggttctggggaccgtttgatgggttcggcgcctttggacggccatgaacataaggttcagtgtctttgcagctccaatccccttgagaccctttcttcgaaaccctttgggggatggtggaaccaagttcccccccctttttgggggtggggaccctttctttttaaaccctttggaaaattgaggcccccccctggtttttcacaaaggtttcccccccggggaaaatccggggggagctttttgaaaacacaaatttccaacaaggtgtaaaattttcttgggtttttttaaaagcccccttaatgggggcggggggggagcctttttcaaaattttttctttaaaaaaagaaaaaaca

SEQ ID NO: 35909 - DNA, 777 bp, Zea mays
  misc_feature: Ceres CLONE 1418357-F
  misc_feature: Translation starting site: 201
  misc_feature: SWISSPROT Homolog: EC 2.3.1.61 Dihydrolipoyllysine-residue succinyltransferase
  misc_feature (13)..(13): n is a, c, t, g, unknown, or other
  misc_feature (34)..(34): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
gtttttttggtgnggggggggggaaaaaagaaangnacnntnnnntaatttttttttataacggagctccccgcggtggcggccgctctagaactagtggatcccccgggctgcaggaattcgcacgagaccattacctagaacatcctaatcgaaaagccgcacttaagtactacaatcccaggggccaggccaccggcatgttcgcttccatctgccggcggcggctcctccgcctctgccaaatccccttcggcaccggcgcaatccctagcgacgccctcccccactgccactccttagcaaccatcgcggacgctcccgtctccgagccctgtgctgcccttgtctcttgcgggctctcccccgccgccgcggtcgcccacaggctcccaaaccgctccaccgccaaggccgaagccctccgcgcgctcctccagcagctacggatttcgccgaagcgggagggtcggccgaccccagtccgcccgattatccgcaaaatccctccggcggccgacccccgacccgtgatcccgcccccaagccttggaccccccttcgatcttccccttcgggggctccaaggccgagggagggctccaccccaaaaaatcccgggcccactccttcaacgcgggcaagcgtctcgaaaaaggcaccctcggtgcccccggggcatacccgaggtccaccccgggcgaaacaatccttccagacaacctgtatgagaggaatgctcctggccatcgcaccaatacccaggagtcatcccct

SEQ ID NO: 35910 - DNA, 814 bp, Zea mays
  misc_feature: Ceres CLONE 1418366-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (56)..(56): n is a, c, t, g, unknown, or other
gttggggggttnnnntnntnngcacacctggggtnnnnnnnnnnnnnnnnnaaaantggagctccccgcggtggcggccgctctagattagtggatcccccgggctgcaggaattctcacgagaccattacctagaacatcctaaccaaaaaaccgtgcagggagcggtggacggtatggattcctcgtcaagctcagctttgaccgcgcggcaatggagagagagaccacagaccatgaccaccatgcccaccgcccagctcgctgctgcacactgtcccactctcctctacctccgcgccaatgcgcctccccaacatttaaacggccaaaccagcccaaaccccaaacccacagtatgtaacaggggcacactagcttaaagctaaaccctcgccacgggcacagcaatggcgccgctcccagctttcccttagggaactgcctcctgggctcttccctctgccgcctcagctgcgccccccgcccctaggttgcgggtcggcgctggttcccgggtgactcccccattcggctcccacaaagcgtcccactctgctcagggcggctccttctgcttaagaggaccccccactccgagaaccggcccccgtcctcacgctgtgtaccatcattaacagtaatgaatcatttctgtattcggttgtgcggccggacccgattatactgcccttcccgttggttggtgcgtggtttctccctatccgcgggcaaagggtaggccccttgtgtggggtaatcgggagctttgtcctgcccttcgtcctgcccccccacccatccaaagcgcccg

SEQ ID NO: 35911 - DNA, 657 bp, Zea mays
  misc_feature: Ceres CLONE 1418372-F
  misc_feature: Encodes the peptide sequence at SEQ ID NO. 35912
ggagctccccgcggtggcggccgctctagaatagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgaacgttctacttcctggtgttcaccatcctggccggcgtggtggccgcgccgtccaagctggccggccgtgcaccacgtggcgcgcctggcgcccataaagcactggcccaccaacgccggggtcgttccctcattgccctgggcccatcacggcggctcgcctttcggggctg

SEQ ID NO: 35912 - protein, 81 aa, Zea mays
  misc_feature: Ceres CLONE 1418372-F
MAGIGRNMVAPLLVLNLIMYIIVIGFASWNLNHFINGQTNYPGVAGNGANVLLPGVHHPGRRGGRAVQAGRPCTTWRAWRP

SEQ ID NO: 35913 - DNA, 702 bp, Zea mays
  misc_feature: Ceres CLONE 1418380-F
  misc_feature: Encodes the peptide sequence at SEQ ID NO. 35914
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (12)..(12): n is a, c, t, g, unknown, or other
nnnngggaaaangggggggaaggttagaagtagagagaaaaaagtttctcttctcttttaatactggagctccccgcggtggcggccgctctagaactagtggatcccccgggctgcaggaattcgcacgagaccattacctagaacatcctaatcgaaaaactcagtctcagagacgttctcctccgtccgtccgcccccgtgacgcgagcgtcgccagggagccgaaagtaagcctcagttccgccggcgtgcgaggggttcgatctgggttagcctctcacgatgccgccagcccccaagtccggcgacgccctcttcgccagcgtggatcgcgtcaatgcggagctgttcacgctcacgtacggcgccatagtgcggcagctgctcacggatctggaggaggtcgaggaggtcaacaagcagctcgatcaaatgggttacaacattggaacacgattggtcgatgagttcttagcaaagtcaaatgtatcaaggtgtgttgacttcaaggagactgccgatgttattgcgaagcttggcttcaaaatgttcttgggtgtgactgcaactgtgaccaattgggatgttgaggggacaagttgcagtattgtcctcgaagacaaccctcttggtggattttggtgagctccctggaccttgccaagggccttcagaaattgcaattttgttaagcaggac

SEQ ID NO: 35914 - protein, 120 aa, Zea mays
  misc_feature: Ceres CLONE 1418380-F
  misc_feature (22)..(121): Pfam Name: TRAPP_Bet3 Pfam Description: Transport protein particle (TRAPP) component, Bet3
MPPAPKSGDALFASVDRVNAELFTLTYGAIVRQLLTDLEEVEEVNKQLDQMGYNIGTRLVDEFLAKSNVSRCVDFKETADVIAKLGFKMFLGVTATVTNWDVEGTSCSIVLEDNPLGGFW

SEQ ID NO: 35915 - DNA, 764 bp, Zea mays
  misc_feature: Ceres CLONE 1418381-F
  misc_feature: Encodes the peptide sequence at SEQ ID NO. 35916
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
nnnnnnnnnnnnnnnnnnnccggggggggggcgggggggggtattaccttataaactggagctccccgcggtggcggccgctctagaactagtggatcccccgggctgcaggaattcgcacgagaccattacctagaacatcctaatctcaaaaagagctccaattcctcgtgcctctgccaatccctccggccctccttccaggcttcaggaccttctcctgcgacgccagcaccgccccgagccgcggcccgaatctagggttcccctctcccgccgtcgacagccggatcgcacatagtgcacctccacgatgctgccgtgcgcgaggtcggtgcttcaaaagagggggctggcatcttccgtcccgcggaggtgccggcgggtagggcaagtgctccccttgccgcgggggagccggtcccccaatgccaggttgttcaagccccctgggctgcccttcggcggggggcgggccccctgctctaacattgggcggcgggtgggcttatcccacaaacccgtcttgatttgggcccggggcgaaaataaacccccccccaaaaaaaggtgttctctttcgggtcccgccaacaggaaagaaaggggggccggcccccccaaagccataaaaaaaaaggacccggatttgtggcccccccccaaacaaaaatttttgtctggttgctccccctcctggcccctccccccgaaattttttgttctgcggtgggccccggtgcccctataaatatatgcggccg

SEQ ID NO: 35916 - protein, 145 aa, Zea mays
  misc_feature: Ceres CLONE 1418381-F
MLPCARSVLQKRGLASSVPRRCRRVGQVLPLPRGSRSPNARLFKPPGLPFGGGRAPCSNIGRRVGLSHKPVLIWARGENKPPPKKRCSLSGPANRKERGAGPPKAIKKKDPDLWPPPKQKFLSGCSPSWPLPPKFFVLRWAPVPL

SEQ ID NO: 35917 - DNA, 827 bp, Zea mays
  misc_feature: Ceres CLONE 1418385-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (38)..(38): n is a, c, t, g, unknown, or other
nnnccccngggccccnnnnnnaccaccgggcggcgagncgggaatttttttttttaaaactggaactccccgcggtggcggccgctctagaactagtggatcccccgggctgcaggaattcgcacgagaccattacctagaacatcctaatcgaaaacttccattcacccgcagctcccatcctctcgctcgccaggagaagcagccgccgttgctgctgccgcgtccacagaatggggggtttcgtgaagacccataagaccaatgggcgttaattttccaaaaacggtttttccccaaagttggaaaattcaagagaacgcgggctgggcaaagaaaaaaattttttttttcaaacccgagccacccaacccgtgcccgcacggcgggagcgcacgggaggggggtgggggggcggtggtggcgttatactatatttacgtggaatgacaaacaaaaaacataaggatgttgtggagtcgatggatcatatacaatagaaaacaggaacacggcgtgccgtaatgagacgcaccaccatagacggcgccatcaggcccacacggtgctacagcaagggaacttcacagcttgtactcatgcgtatagcttggggaggcgcaagcgggggcggaacagaaacttgtatgttctagatatttatattcttttcttatattcttttttgttaagagatgtccggtggtgtggggagtgggcccaaatagaagggagggcagcacgccgcatattctactgcactacgcaccacttaaactgcgggggcgtggcgcggtgactaggttgcgtgtataagagtgaaatag

SEQ ID NO: 35918 - DNA, 636 bp, Zea mays
  misc_feature: Ceres CLONE 1418390-F
  misc_feature: Translation starting site: 215
tgtggatcccccgggctgcaggaattcgcacgagaccattacctagaacatcctaatcgaaaaaaaggaccggtcactcggcacgcaggctagcagcacagcagcagccagagccatcccctctcctcgctttcgcttcgcttcctcggcgccgattcctcctcctcctcctccaccctcgtccgtccccttccggcgcgcgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcgggggatcgcgctaccagctacgatgacttcacaaacagcctccctgaaaatggactgccgatacccgatctatgatttccactttttgttactgcagaggatgtccgaaagagcaggatcttctatatcctatggtccccatccctccccccagggtgaaggagcaagatgctttttgccaggctccaacccagaaattccagaaggggccctcatggggattccagggtggaacctcccggccccccgaatgcgaagggaaatccccccgtccgatgaaaat

SEQ ID NO: 35919 - DNA, 755 bp, Zea mays
  misc_feature: Ceres CLONE 1418394-F
  misc_feature: Encodes the peptide sequence at SEQ ID NO. 35920
  misc_feature (5)..(5): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
ggggngggcccccggggnngnnggggggggggcgggnncnnnnnnncaccccnaagaaaaaactggagctccccgcggtggcggccgctctagactagtggatcccccgggctgcaggaattcgcacgagaccattacctagaacatcctaatcgaaaataactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatctttcagccccgggctcgtccccgccggcggctgctcaacggggagggccgttcttgggagttccttcacgtccggggcgcgctgggggcctcgggggggcctggcccttcgcttaaaggtggccctcgccacaacaacggaagacggggaagggggttttccccggcggcaaccctccggggacttaacctttgggaaaggaaggcggcgcaacccggcaaaaggtaatggggccgg

SEQ ID NO: 35920 - protein, 160 aa, Zea mays
  misc_feature: Ceres CLONE 1418394-F
  misc_feature (44)..(142): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLAVATPVFLIFQPRARPRRRLLNGEGRSWEFLHVRGALGASGGPGPSLKGGPRHNNGRRGRGFSPAATLRGLNLWERKAAQPGKR

SEQ ID NO: 35921 - DNA, 612 bp, Zea mays
  misc_feature: Ceres CLONE 1418395-F
  misc_feature (170)..(170): n is a, c, t, g, unknown, or other
  misc_feature (441)..(441): n is a, c, t, g, unknown, or other
  misc_feature (449)..(449): n is a, c, t, g, unknown, or other
  misc_feature (496)..(496): n is a, c, t, g, unknown, or other
  misc_feature (511)..(511): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (606)..(606): n is a, c, t, g, unknown, or other
ggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccanccggggtgcgacgggaggtggcgggggctacggcgacctccagcgcgggggcggcatgcacggcgaaggccccaccagcaaccaaaaagccaggggccgcccatgaatgaacgggcggcttaaagggcccccgaaacggggcccgccaaacctttttccgggggggggcccaaaggccccggggggccctgtttcccccggggggttgttaaaatttctttggggggcgcgggggaccccaccccggtatatttccccctccgcccccccntaaccggnggggcgggggggtggtccctcctttttctccctcccccacccccccnttttacccccccccnacttccccccacaccaccccccgccttgtcggcttttttgcgcctaccccgnnnagccgccccccggccttcgcctcttttatccgccacccgcncccccc

SEQ ID NO: 35922 - DNA, 626 bp, Zea mays
  misc_feature: Ceres CLONE 1418396-F
  misc_feature: Encodes the peptide sequence at SEQ ID NO. 35923
acccgcggtggcggccgctctagaactagtggatcccccgggctgcaggaattcgcacgagaccattacctagaacatcctaatcgaaaaatcataaaaaaaagacaccctgcgtcatttaccgaccaccgtccatccatggatgcagccgagggccgaggggcagagtgggccgaggggcgtggcaggcggtgagcacgccggtggtcgggacggtacggatctcgtgatccatggccttcgcgggatggcgctgctccctgcttatgacacctcccgttcaccggcagcgaatcggggcttggcatttcccatcaagcattaagcagtgaagcaccccccctcgtttccaccggcagtccggcagcgagcagacagtaacagaatcaggcggtgtcttggaaataacttcagtgccatggcctggtctcatggaacatctccattatttccagtttacaagcttgagcagatcctgatgcgaggaccctccatctgtgatactctcgcacgctgctctcttcaaagaaagtgccctcgctctgatcgtatcatcagcgagcagctggttgactttgtccctgatctcctccttggtgaagacgccccgctcgttggcacggatc

SEQ ID NO: 35923 - protein, 69 aa, Zea mays
  misc_feature: Ceres CLONE 1418396-F
MAWSHGTSPLFPVYKLEQILMRGPSICDTLARCSLQRKCPRSDRIISEQLVDFVPDLLLGEDAPLVGTD

SEQ ID NO: 35924 - DNA, 647 bp, Zea mays
  misc_feature: Ceres CLONE 1418467-F
  misc_feature (397)..(397): n is a, c, t, g, unknown, or other
  misc_feature (408)..(408): n is a, c, t, g, unknown, or other
  misc_feature (409)..(409): n is a, c, t, g, unknown, or other
  misc_feature (414)..(414): n is a, c, t, g, unknown, or other
acccgcggtggcggccgctctagaactagtggatcccccgggctgcaggaattcgcacgagaccattacctagaacatcctaatcgaaaaaaaaaaccctatcccagtaaacgccgcggctccttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgcccctaatcagnaccctcctcgnncgcgncatctggtgcgccgctttactcgccgctgccatctcctccgctttctgattccaattccccatccccaaccctaacctcccccctgaagcaaaccccaacctcccgctttgaagggcctactaaatttggaaactcttcccgccgaatcggttcaaatttacccccccttcggtaccatggggaaccccaaattttttttcgcccccgtggggacgggaaagtaattttttgt

SEQ ID NO: 35925 - DNA, 619 bp, Zea mays
  misc_feature: Ceres CLONE 1418476-F
  misc_feature: Encodes the peptide sequence at SEQ ID NO. 35926
  misc_feature (619)..(619): n is a, c, t, g, unknown, or other
gctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggggatggaactacaactgcctctgttctcgctagggagatcatcaaattgggcatgttgagcattacttcaggggcaaatccagtgtccgttn

SEQ ID NO: 35926 - protein, 161 aa, Zea mays
  misc_feature: Ceres CLONE 1418476-F
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMLSITSGANPVSV

SEQ ID NO: 35927 - DNA, 807 bp, Zea mays
  misc_feature: Ceres CLONE 1418481-F
  misc_feature: Encodes the peptide sequence at SEQ ID NO. 35928
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
gcccacacccggggaaaaggtgggttgtttctatctttttttgggagaacnnnncaaaactggagctccccagcgtggcggccgctctattttagtggataccccgggctgcaggagttttcacgagaccattacctagaacatcctaatcgaaaaactgttcggagggtcgtatctccccagacgtccacaccctccggagcgtcgcagcgatccggcgcctccttatccccttcacacgtccatggcggagcgcggcggcgaacgtggcggcgagcgcggcgggcatggccgtggcttcgggcgcggtggtcgcggcgaccgtgcggggcgccgaggggggctgtcgcgttcctgtttatggaggtatagggggtgggtccttgttaggtaaactcggggcgtctcgactagggacgctccgggctcttttaggagtggaggaaggttgttatgtgctgcgcgctgacccgttttatgaaggttccgtgaactcccccaacaacccgttttacggacgtgaggtctccaggggtatggaggttttacagcagcgaaccgcggcccctctttcctcattaccacaatcccccccgttctgagacggcgcacacccggcaggccaaagccccttttggacagccttctgtgccgtttgtgcgtgggagacatgtttggtctcggcgcagcccaagtgcgtcgtcataaagccgtgggactatgggctggtcctggggcctctcttgccacccgccgtgcaatgcctctctttgtatcttcattacaaaaaaaaatgagggggggggg

SEQ ID NO: 35928 - protein, 49 aa, Zea mays
  misc_feature: Ceres CLONE 1418481-F
MAERGGERGGERGGHGRGFGRGGRGDRAGRRGGLSRSCLWRYRGWVLVR

SEQ ID NO: 35929 - DNA, 671 bp, Zea mays
  misc_feature: Ceres CLONE 1418485-F
  misc_feature: Encodes the peptide sequence at SEQ ID NO. 35930
  misc_feature (392)..(392): n is a, c, t, g, unknown, or other
tggagctccccgcggtggcggccgctctagaactagtggatcccccgggctgcaggaattcgcacgagaccattacctagaacatcctaatcgaaaactcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatggggccgtanaaggaagcggggggagggctcgtcaagacgctgcagctggggtcgctcttcgggctctggtacctcttcaacatctacttcaacatctacaacaagcaggttctgaagggtctgccataccctataaacatcaccacagtgcagtttgccgtttggaagtgccattgcttttgtttatggtggatcaccggttatccttaaaaggccaaaagatttctggtggcccagcttttttgctatcctttcctctagctatcgttcataccatggggcaatctt

SEQ ID NO: 35930 - protein, 177 aa, Zea mays
  misc_feature: Ceres CLONE 1418485-F
  misc_feature (85)..(85): Xaa is any aa, unknown, or other
MQSTAAIGLVRPCAARPLPTYPSPRRGAGACSGAAQPILAPRGLCLSARASLLPDSPLEEEYRRCRAGRHVAAAGKVAAADGAVXGSGGRARQDAAAGVALRALVPLQHLLQHLQQAGSEGSAIPYKHHHSAVCRLEVPLLLFMVDHRLSLKGQKISGGPAFLLSFPLAIVHTMGQS

SEQ ID NO: 35931 - DNA, 607 bp, Zea mays
  misc_feature: Ceres CLONE 1418487-F
  misc_feature (196)..(196): n is a, c, t, g, unknown, or other
tggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccatactgncagctgtgttcatcaaagcttattaggctccctctacatctgatccagctaagtagctagccagcactacggaagggcgtggcaagaatcaggaaaaaattacaggggggctagctagctgaactccggccaacaaaaaatggccgaattggcaagaaaatgggggccccccctcccggggcccaacccccctgggaaaacccccctcccgtttcccggggggaacctaaaccctttctcaagggggaaacactcccccccggggggccggaaaggcgccaattttatttccggggggccccccccccgccgcgggggggggggcggccgcccaatggtgggggggggaaacaaaggggggccgtggggcccaaaaaagggtggaccaaaaagcgggtttttttttttttt

SEQ ID NO: 35932 - DNA, 745 bp, Zea mays
  misc_feature: Ceres CLONE 1418495-F
  misc_feature: Encodes the peptide sequence at SEQ ID NO. 35933
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
tttgtgtttgtttttttttttggggtggggggggnnngcctttttttttataaactgggactcaccgcggtggcggccgctctagaactagtggatcccccgggctgcaggaattcgcacgagaccattacctagaacatcctaatccaaaaaggccctagcaacaaatccgaatcccgagtccggcgacggcagtatccgagctcgcactcgcgcacccgtccatcgcatcgcatctgtcctcccatcccctcagcgccaccgcaccgcaatcacacgcgcgccacccgcgatgacgccggcggcggcgatctccggctccagcagccacgtcgtcgtctcctccgcccgcctcaggcagccgttcacgctccctccgcgcaccgcttgcccaatcgccgccgccgcctcgcccgtgacccgccgcggggtcgcggtcgccgccgtgtcgagccccgttgtgtccgccgccgcggggaaggatgccaaacaggctcctaaggatttccttcaaatcattgattttgacaaggatacaataaatgaagattcttaatcgagccatcgaggttaagggcattgataaagtcttggagaccaagagctttccaaaccgttccaaaggggaaaaacaattgggccattgattttttgcccaaggccactcaaatggaaggaacccgtggttttccattttgaagaacgggaattcctttttttaccttggggggggggccattgcctt

SEQ ID NO: 35933 - protein, 87 aa, Zea mays
  misc_feature: Ceres CLONE 1418495-F
MTPAAAISGSSSHVVVSSARLRQPFTLPPRTACPIAAAASPVTRRGVAVAAVSSPVVSAAAGKDAKQAPKDFLQIIDFDKDTINEDS

SEQ ID NO: 35934 - DNA, 787 bp, Zea mays
  misc_feature: Ceres CLONE 1418497-F
  misc_feature: Encodes the peptide sequence at SEQ ID NO. 35935
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (26)..(26): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
cccccccccccnnnccnnnnntcatntgtatntnnnnngntcgcacgaaccnnnnaaagttggagctccacgcggtggcggccgctctagaactagtggatcccccgggctgcaggaattcgcacgagaccattacctagaacatcctaatcgaaaaaaattactaatggccggcacaaccaccagcacggtcacgtccccgcctctcccctcctataccctcgcctccgcaaccgccgcagccgattcttcgcggcctcctcctcctcctcctcgcctcagatggcggcgcctgccgacgccgccggtggctccactgacgcgttcgaggtgatccgcgttcaccaggcaaaagctgttcgtctttctccagttgaagaaatacggaccattatggaacgaagtgtcaaatgtgtttcttgctacccattctcaaggatcatgcttggttatcccatctgggttcattggtagaattttgagatgggatccaggaatgggtttacccccacaattacccacgggagtatatttaagcaggcccttttccataaaaatcaccctccgggaaacccctaaaaatgcctcactttcttttggtttgcccaaataatccgtgtatgaacagagactgaaaaaccggaaaaaccaccctggaaaatgggcagaattctaggtcccctggtgtttcgggcaccaagagaaacaaattccaggtggaaaaattggctttacccgtgaccgagggtacccccgtgagagctctttcctggggcgctaacatcgg

SEQ ID NO: 35935 - protein, 63 aa, Zea mays
  misc_feature: Ceres CLONE 1418497-F
MAAPADAAGGSTDAFEVIRVHQAKAVRLSPVEEIRTIMERSVKCVSCYPFSRIMLGYPIWVHW

SEQ ID NO: 35936 - DNA, 668 bp, Zea mays
  misc_feature: Ceres CLONE 1418501-F
  misc_feature: Encodes the peptide sequence at SEQ ID NO. 35937
  misc_feature (344)..(344): n is a, c, t, g, unknown, or other
tggagctccccgcggtggcggccgctctagaactagtggatcccccgggctgcaggaattcgcacgagaccattacctagaacatcctaatagaaaaaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcnagggagtgcgggtggaggacgcgatgacggctgccgagcgcagccccttctacctctacagcaagccacagatcctccgcaacttcgccgcctaccgcgatgctctccaggggctccgctccatcatcgggtatgccgtggaggccaacaacaacctccccgtgctacgcgtcctgcgtgagcttggctgcggcgccgtcctcgtcagcgggaacgagcttcgactcgcccttcagggcgggattcgaccccgccagggtgcatatttaacggaaaggggaagacactccaaacatcttaaattacctggctgaaaaggggaag

SEQ ID NO: 35937 - protein, 183 aa, Zea mays
  misc_feature: Ceres CLONE 1418501-F
  misc_feature: SWISSPROT Homolog: EC 4.1.1.20 Diaminopimelate decarboxylase
  misc_feature (80)..(80): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCXGVRVEDAMTAAERSPFYLYSKPQILRNFAAYRDALQGLRSIIGYAVEANNNLPVLRVLRELGCGAVLVSGNELRLALQGGIRPRQGAYLTERGRHSKHLKLPG

SEQ ID NO: 35938 - DNA, 658 bp, Zea mays
  misc_feature: Ceres CLONE 1418502-F
  misc_feature: Encodes the peptide sequence at SEQ ID NO. 35939
  misc_feature (319)..(319): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccancttcggtgcatctcccaccggccggtccacctgccgccgccggtccacctgccacccccgggccatgtgcgcccccggtttatttggccgcggccccatgccattaccttattaaacggccccgggcttaacctcttccccaaccaacccatggccggggcaaaagcgcgttccaaaccccggacacttgggggagaacccgggggtttggaaccccccccatccgggggccgggtgttaatttttaaaaatttttggggcccccggggggaccccctagtgccccccaaggccatttttgggggaaaattttttcccccccccccggggggggacccc

SEQ ID NO: 35939 - protein, 92 aa, Zea mays
  misc_feature: Ceres CLONE 1418502-F
  misc_feature (50)..(50): Xaa is any aa, unknown, or other
MRVLLVALALLALAASATSTHTSGGCGCQPPPPVHLPPPVHLPPPVHLPXSVHLPPAGPPAAAGPPATPGPCAPPVYLAAAPCHYLIKRPRA

SEQ ID NO: 35940 - DNA, 746 bp, Zea mays
  misc_feature: Ceres CLONE 1418503-F
  misc_feature: Encodes the peptide sequence at SEQ ID NO. 35941
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (54)..(54): n is a, c, t, g, unknown, or other
  misc_feature (55)..(55): n is a, c, t, g, unknown, or other
  misc_feature (61)..(61): n is a, c, t, g, unknown, or other
aaaagggggaannnngaaancctggaaacagggtaaaagaacggaaaggggaanncaattntttttttttaagctggagctccccgcggtggcggccgctctagaactagtggatcccccgggctgcaggaattcgcacgagaccattacctagaacatcctaatcgaaaagtgttccgtgtccgcatccagtgtgtccgctccccctcagtcctagcggtagcgtgcgcgcgggagacgtagatggcggcttcggcggcggcggcggcggcggcggcgacaccggtggcgccgacagaggggacggtgatcgcgatccacagcctggaggagtggagcatccagatcgaggaggccaacagcgccaagaagctgggggtgattgacttcactgcaacatggtgtcctccgtgccgcgccatggctcccattttttgctgatatggccaagaagccccccaatgttgttttccctgaaagttgatgtcgaatgaaaaggaagaacatttgctgaacaaattcaagcgaaagagggcctgggccaaaatttccctgtttcttgaagggaaggggccaccttcaaggaacaagggttctgttggcgcccccccaaaggggaaaaaatcttgcaagggaaatctttgaaacaaaaacccagggggccctccaaaaaaaataaagggaaggcccgccataatggggaatatattccccgcccaaataaaaaaaaaaaaccgcccctcccc

SEQ ID NO: 35941 - protein, 65 aa, Zea mays
  misc_feature: Ceres CLONE 1418503-F
  misc_feature (22)..(64): SWISSPROT Homolog: EC 3.5.1.52 Peptide-N(4)-(N-acetyl-beta-glucosaminyl)asparagine amidase
  misc_feature (46)..(64): SWISSPROT Homolog: EC 1.8.1.8 Protein-disulfide reductase
MAASAAAAAAAATPVAPTEGTVIAIHSLEEWSIQIEEANSAKKLGVIDFTATWCPPCRAMAPIFC

SEQ ID NO: 35942 - DNA, 680 bp, Zea mays
  misc_feature: Ceres CLONE 1418505-F
  misc_feature (243)..(243): n is a, c, t, g, unknown, or other
tggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgcccgcgccgccagatccccangccttcgttgaacccttcgccgtaacgagatcagatggctgggtatatgtcaagaaggccccaaaatgggtctgtgtatgtctgcatcctacctcctgaactgatgaaaaatttttgggtaattatttggccccaaggctgcttaaagggatggggtctaaccaaaaggacaaaggaccggggccccaaaatattggatattccggggaaaaatttttataaaaacccagggggggatccccccccccctttaaaagccccccgggcggttccccccgggggggagaggcctcaaaaaaagtttttccggggggaacattcccggggcccacttgcggagaaaaaaacaaaaaggcttccctcccccccccttttttaaacctctcggggggggggggaaaaaaaaaaccttgttagtagccgccctagaaagccgg

SEQ ID NO: 35943 - DNA, 769 bp, Zea mays
  misc_feature: Ceres CLONE 1418510-F
  misc_feature: Encodes the peptide sequence at SEQ ID NO. 35944
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (35)..(35): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
nnnnnnnnnnnggaaaannnaaagaagngaaaaangggggnntntttacaattcaaaactgggactcaccgcggtggcggccgctctttttctagtggatcccccgggctgcaggaattcgcacgagaccattacctagaacatcctaatcgaaaacttttgagaactccccttctccgccactaccgaagcccttgtacccctcaccgccgccgctgctgctagggagcttccatccgcgcgcgcctacaacgagagctagcagcggtagcggccgttatcttgtcgctccggctccgttcgtgtacccaagtcccagcctagatgccgcagatggaggggtccactgatcagatcgccgccggctggttcgctaaggagccggcttccgagcggcccgtgggcttgccgaggaccggttcttccagtcgcctcaacgcgcaggcgccgggagttcgtgccgcggggggccgccgccaccggcgccgggcggttgtgcttgccacctcccgccgcaaggtgatccagcatgtttcggcggaggcctccccacgcccggcggggaggggggctttcttcttccggctgccgaaaccccccggccggttcgaagaacctaggccccctaatcggtagaaccccaaccgggattttgcttggccaagggaaccaacagggccccccggaaactgggaaaacgggaaaatggcttccccccaccggcccggcggatgtgaataaccggaatacccggggtggtgggaaaggg

SEQ ID NO: 35944 - protein, 103 aa, Zea mays
  misc_feature: Ceres CLONE 1418510-F
MPQMEGSTDQIAAGWFAKEPASERPVGLPRTGSSSRLNAQAPGVRAAGGRRHRRRAVVLATSRRKVIQHVSAEASPRPAGRGAFFFRLPKPPGRFEEPRPPNR

SEQ ID NO: 35945 - DNA, 639 bp, Zea mays
  misc_feature: Ceres CLONE 1418551-F
  misc_feature: Encodes the peptide sequence at SEQ ID NO. 35946
  misc_feature (639)..(639): n is a, c, t, g, unknown, or other
tacccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcaccaccttcttcagccagactggtgctgggaagcacgttccccgtggaatcttcgttgatctaaaacccactgtgatcgaagaggtgcgcactggcacgtaacgcccagctcttccaccccgggaggagttaatcaatggcaaggagggatgccccttaaccattttacccccgggggcccctaaccaattgggcaagggagaatgggtgaacctggggccttggcccgtatcccgccaagctn

SEQ ID NO: 35946 - protein, 82 aa, Zea mays
  misc_feature: Ceres CLONE 1418551-F
MRECISVHIGQAGIQVGNACWELYCLEHGIQPDGQVPGDKTAGHHDDAFTTFFSQTGAGKHVPRGIFVDLKPTVIEEVRTGT

SEQ ID NO: 35947 - DNA, 663 bp, Zea mays
  misc_feature: Ceres CLONE 1418555-F
  misc_feature: Translation starting site: 190
  misc_feature (507)..(507): n is a, c, t, g, unknown, or other
  misc_feature (508)..(508): n is a, c, t, g, unknown, or other
tggagctccccgcggtggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctactcgccgatcgatacgatggccgtcttctccgacctccacaccgccgacggcctcaagtccctcgaggctcacctcgccggcaaaacctatgtgtctggtgacgccattagtaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaagatgatgatgaccttgatctttttggtgatgaaactganngagacaagaaggcacctgatgagcgtgccgccgctgcccaggccctcttctaaaaagaaggaaagtggtaaatcctcccgtccttatggatgtcaaaccttgggacgatgagactgatatgaagaagctggaggaggcttgccgcaattggccaa

SEQ ID NO: 35948 - DNA, 603 bp, Zea mays
  misc_feature: Ceres CLONE 1418561-F
  misc_feature: Encodes the peptide sequence at SEQ ID NO. 35949
  misc_feature (554)..(554): n is a, c, t, g, unknown, or other
aagctggagctccccgcggtggcggccgctctagaactagtggatcccccgggctgcaggaattcgcacgagaccattacctagaacatcctaatcgaaaaattatcacagcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacaatacccaagggccgctttccgccttcacccaatcaggggatgaaggatgctnaagttcaagcttttgcaagggttagggtctggttcagttttggggcaga

SEQ ID NO: 35949 - protein, 128 aa, Zea mays
  misc_feature: Ceres CLONE 1418561-F
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (121)..(121): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYNTQGPLSAFTQSGDEGCXSSSFCKG

SEQ ID NO: 35950 - DNA, 684 bp, Zea mays
  misc_feature: Ceres CLONE 1418564-F
  misc_feature: Encodes the peptide sequence at SEQ ID NO. 35951
  misc_feature (176)..(176): n is a, c, t, g, unknown, or other
  misc_feature (287)..(287): n is a, c, t, g, unknown, or other
  misc_feature (288)..(288): n is a, c, t, g, unknown, or other
  misc_feature (295)..(295): n is a, c, t, g, unknown, or other
  misc_feature (339)..(339): n is a, c, t, g, unknown, or other
tggagctccccgcggtggcggccgctctagaactagtggatcccccgggctgcaggaattcgcacgagaccattacctagaacatcctaatcgaaaaaacgaagaaccgaatgcccagtcctgaatcacgtcttcacccgtgctcgtgcgctgcgcccatcccttccgcctccacngctccccacgtggcaccgtgcacagcaccacacagccaggtccccatggcggcggcggcggcggttgcgtctgcgacgacgggcgaagagaagcgcgcctgctgcgcctgnnagagcangcggaaccacgcggcggcggcgcctggaaatacctctgcctcgnccgcgggttccggggccgccgccccgttaaggttctccggggtggcctcgccctcttaaaaaagccttccgggggttcgggctttgcctaaaaaagtggaccccctaaaagaagggggccacggggccatggatttcccccctccccattgggaaaaagactgttttgaacccttttaaaaaatttcccgggagaaccccggttgcccgcaaaaaaaacccccttttttaaaaaaaaaggaaagtggggtaaaaaaaaaaaacccccccccccttcccgaaaaaaatctttttttaaatttttccccaaaaaaaaaattttctccccaacaaaccgggggtgggt

SEQ ID NO: 35951 - protein, 58 aa, Zea mays
  misc_feature: Ceres CLONE 1418564-F
  misc_feature (22)..(22): Xaa is any aa, unknown, or other
  misc_feature (23)..(23): Xaa is any aa, unknown, or other
  misc_feature (25)..(25): Xaa is any aa, unknown, or other
  misc_feature (40)..(40): Xaa is any aa, unknown, or other
MAAAAAVASATTGEEKRACCAXXSXRNHAAAAPGNTSASXAGSGAAAPLRFSGVASPS

SEQ ID NO: 35952 - DNA, 692 bp, Zea mays
  misc_feature: Ceres CLONE 1418565-F
  misc_feature: Encodes the peptide sequence at SEQ ID NO. 35953
  misc_feature (307)..(307): n is a, c, t, g, unknown, or other
  misc_feature (403)..(403): n is a, c, t, g, unknown, or other
  misc_feature (406)..(406): n is a, c, t, g, unknown, or other
  misc_feature (626)..(626): n is a, c, t, g, unknown, or other
ggagctccccgcggtggcggccgctctagaactagtggatcccccgggctgcaggaattcgcacgagaccattacctagaacatcctaatcgaaaaaaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgncgcggaagacgatgaggacttcgaggccgactttcgagacttttgagccgactccggtgattcggatttggacctcgggggaaggggctgacaacnacntcatcgaaatcaggccctttcgcgcccaaaatactttccccaaaaatggtttaagccccatgactacgggtggttttaaagccccccggcccaagggttggccaaaagggaaaaggaaaaacccttttcggggttatccccccacccccccttggggaaaaggggggcttctaaaaaacaaaaaccccccaaaaaggcggccccgggtttggggtttggnccctttcaaaatcccccggaaaaactccgcaaaatttttttttttttaaacccccccgaatttttt

SEQ ID NO: 35953 - protein, 56 aa, Zea mays
  misc_feature: Ceres CLONE 1418565-F
  misc_feature (42)..(42): Xaa is any aa, unknown, or other
MCGGAILAELREPAPRRLTERDIWQQKKKPKRGGAGGRRSFXAEDDEDFEADFRDF

SEQ ID NO: 35954 - DNA, 657 bp, Zea mays
  misc_feature: Ceres CLONE 1418569-F
  misc_feature: Encodes the peptide sequence at SEQ ID NO. 35955
tggagctccccgcggtggcggccgctctagaactagtggatcccccgggctgcaggaattcgcacgagaccattacctagaacatcctaatcaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctggccgcgccggtccacctgccaccgccggtccatgtgccgccgccggttcatctgcccgcgccaccatgccactaccctactcaaacgccccgggctcagcctcttccccaggcaaccccatggccgtgccaacagcccgcatccaagccgtggcaactggagggaacttgggggtttggagccccccccatcctgggccaggggcccaattcccgaagattaatggaaccccaaggggaaccccctttggtcccccaagggccatttttggggaaacgtgtttcccacctccccgggggggggcccccccc

SEQ ID NO: 35955 - protein, 163 aa, Zea mays
  misc_feature: Ceres CLONE 1418569-F
MRVLLVALALLALAASATSTHTSGGCGCQPPPPVHLPPPVHLPPPVHLPPPVHLPPPVHLAAPVHLPPPVHVPPPVHLPAPPCHYPTQTPRAQPLPQATPWPCQQPASKPWQLEGTWGFGAPPILGQGPNSRRLMEPQGEPPLVPQGPFLGKRVSHLPGGGPP

SEQ ID NO: 35956 - DNA, 732 bp, Zea mays
  misc_feature: Ceres CLONE 1418570-F
  misc_feature: Translation starting site: 388
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (40)..(40): n is a, c, t, g, unknown, or other
  misc_feature (42)..(42): n is a, c, t, g, unknown, or other
ngggggggnnnnnnggnngggggaaaaggaatggaagcgngnaaaaacagatttctcacactggaactccccgcggtggcggccgctctataatagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcgagaaatcgggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttatgttgggggccactgaaataatcgctagtgtcaaggctgaatttaggaaaaccaagcattttttcacccctgacaaaaggaaaaagtttgccattttttggtccgactggtagtcccaaacccgcctgaagcccccctgttttgaagggggtagaagggcctcctggaaaaaaaatttgtccctggcttgacagcct

SEQ ID NO: 35957 - DNA, 748 bp, Zea mays
  misc_feature: Ceres CLONE 1418571-F
  misc_feature: Translation starting site: 293
  misc_feature: Pfam Name: DUF591 Pfam Description: Protein of unknown function
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
nnnnnnnnnnnnnnnnnnnnaaaaggggcccggcccgcgnnnngcagggccggccagaaacaggcactccccgcggtggcggccgctctagaatagtggatcccccgggctgcaggaattcgcacgagaccattacctagaacatcctaatcgaaaaacccgatctccaaatcgcccccccaaaccctcttcttcccccttcccgtgctcgacccagatcgagggctcgatccgtcggccatggcgctggagtgggtggtgctgggctacgcgggcgggcgcggaggcgatcatgctgctgctgctgacgctgccggggctcgacggcctgcgccggggcatgatctccggggtgcggagcgcgctgaagcccatgatgtcggggggggccttcggcctcttcctgctcatggacatccacgggaagtacgagacgcgccccacctgcgacgacgagcacgcctgctccccctccgagcacctccggcaccagaaagccaatcaggaaggtcgcagggggaacgggtctcttcatcggccgccggcgctgcctcctctacggggaatcctctttccccggccacccccagtctccggccgtcaggggtccgaagaagatggctagcaggggggttcgaacaaggtttcgggaaggccgcgaacgaccggaagggggatccgcgcatcccagggggggagggggctccggtgtctgcccgttggggcctggggccgtgggggcttctcg

SEQ ID NO: 35958 - DNA, 805 bp, Zea mays
  misc_feature: Ceres CLONE 1418578-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (59)..(59): n is a, c, t, g, unknown, or other
nnnnnnnccccnnnnnnnnnggggggggggggggcgggttcgggggcttctttcttttnattctggagctccaccgcggtggcggccgctctatactagtggatcccccgggctgcaggaattcgcacgagaccattacctagaacatcctaatcgaaaaacggttcttgttcttcttcccacccagcgtgcgctccctcttcctcttccccttctctctcggcgacgactgggtggccgtagctgcctccatacgcctggtgccctggtcttcttcgggccattccccggccgcaacaccaccaaaagggagagcttcccaggtagagctgtttcttcctactctaacaaatggcagggataaagcctaagcaaattgctaatccaaagcaaaacagagaaaggctcccttctcgaaacagcttcctctactattcatcacatgggaaacttgattggtcattaattgggttgggcctattttcttctttgcctaccctatcagccccttttgggtatcaaagaggtccctgcccccaaaaactttcccaaaagggggagctttcctttgaaaaccctgaaaccttgggttgggagaaaccccggagggaactccccacaatgtgtaatgtttcgacccatgaataatgcggggaaaatggaaaacccccccaaaaaagggccccaattttctcctgtcgaaaattttcaaaaaaaattcctttccctcctatacccttttgtgggataaaaattttttcccaccacgggtggaaaaaaatatactctttcttttgcaggagtg

SEQ ID NO: 35959 - DNA, 774 bp, Zea mays
  misc_feature: Ceres CLONE 1418585-F
  misc_feature: Encodes the peptide sequence at SEQ ID NO. 35960
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (47)..(47): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
ncccccnnnnccnnnnnnnnnnnnnnnnnnnnnnggnngggnnnggngggggggggnnnnaaatctnnnnnntaaaaactggagctcaccgcggtggcggccgctctagaatagtggatcccccgggctgcaggaattcgcacgagaccattacctagaacatcctaatcgaaaaagtctcttggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaagttttcagagtctcggcgttgcattctacgggggagcaaattgttgtgccctagtctaagatgttaattcaatgaaatcattttgacaaccggaaataactgggcgagaaaagtttcctaattcagggctaccccaatcagaatcctgaaaaattccccttttggttccggtggggaaaacaaatttgaatgtaaaatggggggcaaaaaagcccgccgtgggtattctagaaaaaaaaaggcaaaaagggcttggggggggcctttcccaaaagggagaaacattcccccggtacttt

SEQ ID NO: 35960 - protein, 87 aa, Zea mays
  misc_feature: Ceres CLONE 1418585-F
  misc_feature (10)..(88): Pfam Name: Ras Pfam Description: Ras family
  misc_feature: SWISSPROT Homolog: EC 2.7.11.1 Non-specific serine/threonine protein kinase
MASRRRTLLKVIILGDSGVGKTSLMNQYVNKKFSNQYKATIGADFLTKEVQFEDRLFTLQIWDTAGQESFQSLGVAFYGGANCCALV

SEQ ID NO: 35961 - DNA, 615 bp, Zea mays
  misc_feature: Ceres CLONE 1418587-F
  misc_feature: Encodes the peptide sequence at SEQ ID NO. 35962
gctctagaactagtggatcccccgggctgcaggaattcgcacgagaccattacctagaacatcctaatcgaaaaattgtagcatgtgttagtcattgccttcctcttgtcgtcatctgctggtgcaggagcgccgagcgcagatccatcaggattggagtgttttcctcgtcttcaagcgagaagggtcttcaggacttgttttttgggcgggcgcagttgcggagatgcagaggctgggggatttcaggctccctcccttcttcaactaccctccttacttcacctatatgtggaagagatggtccatgatgctgaattggttatggatgtaatctaatttgcagcctatgcgtgaaacacgggaaaagcaagtacaggtttgggaaaatatgatactcgattactgtagaaggcaaaagataccttccatatccctggaaacaaaatttcccccctgttctcccatcccaaaaatgggagagattcctttacctattgaaccaaaaggaaggggtccctttgcacctccccccttcaacgtaatgggccccggctccaatggggaagggaacaaaagggcgcccccaaacaaaggggccctcttgtttttttt

SEQ ID NO: 35962 - protein, 88 aa, Zea mays
  misc_feature: Ceres CLONE 1418587-F
MRETREKQVQVWENMILDYCRRQKIPSISLETKFPPCSPIPKMGEIPLPIEPKGRGPFAPPPFNVMGPGSNGEGNKRAPPNKGALLFF

SEQ ID NO: 35963 - DNA, 652 bp, Zea mays
  misc_feature: Ceres CLONE 1418589-F
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (39)..(39): n is a, c, t, g, unknown, or other
  misc_feature (40)..(40): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (72)..(72): n is a, c, t, g, unknown, or other
gggggggtgttccccccgatnnnncannnnnnnctcgcnnaatgggggggccccgggannnnaaaatnnntntaaaactggagctcaccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaatatttttgcctcctatgctctttgtcttctgcaagggctgctaggcgacattttcccgcatgctcgcaaagctctaatagttcccttcttccccgtacctcttaacaaacgggggtcttccggatggggaaaaacccatttttttcaaccctacggggattccaaaaggggaaatccccgggcgggggaatttttaaccctttttataaccccctttggtttcccccccacaaaataaccttccgccccccatattaaacccccacgtttcccctcttggggggggcttttttttgggggccaaagaaaaaatatctgggggggacacaaaaaaacttataaaaaaaatttttggggcgtaaaaaaaaaacccttgtgggggcgccgaaacctctccctcaaaaacag

SEQ ID NO: 35964 - DNA, 642 bp, Zea mays
  misc_feature: Ceres CLONE 1418590-F
  misc_feature: Encodes the peptide sequence at SEQ ID NO. 35965
ccgcggtggcggccgctctagaactagtggatcccccgggctgcaggaattcgcacgagaccattacctagaacatcctaatcgagaagagtatccgacagttcgccttcccgtctttccctctccccccacacccggtcgtcgtcgtcgcggcgtgagcgtctgagcgagcgtgcgagagcgagaggggggaacacaaaaccctagcaccgtcgccgacggacgccagagtagagagatggcggtggacgaggtgaattcggtctacgtcggcagccttccctacgaggccaacgaggagatgcttcgcgacgccttcgggtactacggcaccatcgtctccgtcaaggtgattaatgatcatactatcaaagggcagtgttatggttttgttactttcactcaccccagagctgctgagcaagcaattgcaggcatggacggcaagaaattaggcatcgtattattcgagtaaatgaagtgcgtacaagaggcccccgagatttttggtcaaatggttttagaccacacccaaaaggggtgggtaaagattcctactggggacaaaaagggtaagggaaacaaactttgatcctggaagaaaattccctccttggacggggataagtggataatccccgg

SEQ ID NO: 35965 - protein, 78 aa, Zea mays
  misc_feature: Ceres CLONE 1418590-F
  misc_feature (9)..(76): Pfam Name: RRM_1 Pfam Description: RNA recognition motif. (a.k.a. RRM, RBD, or RNP domain)
MAVDEVNSVYVGSLPYEANEEMLRDAFGYYGTIVSVKVINDHTIKGQCYGFVTFTHPRAAEQAIAGMDGKKLGIVLFE

SEQ ID NO: 35966 - DNA, 638 bp, Zea mays
  misc_feature: Ceres CLONE 1418606-F
  misc_feature: Encodes the peptide sequence at SEQ ID NO. 35967
catagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactggaccggccggcggcaccgcgcccgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcatgcgctgacggtggtgacgctgttcccgctgggcgggctgctgctggtgctgtcggggctggcgctgaccgcctccgtggtggggctggccgtggccacgccggtgttcctgatcttcagccacgtgcacgtccccgccgcgctgctcatcaggacggacgtcatggggctcctcacgtcgggcgcgctggggctcgggggcctgtcctcgctcaagtgcctcgcccacacggcgcggcaggcgttccagcgcaccccggactacgtggaggaggcgcaccgcatgatggcg

SEQ ID NO: 35967 - protein, 144 aa, Zea mays
  misc_feature: Ceres CLONE 1418606-F
  misc_feature (44)..(144): Pfam Name: Oleosin Pfam Description: Oleosin
MADRDRSGIYGGAHATYGQQQQQGGGGRPMGEQVKGMLHDKGPTASHALTVVTLFPLGGLLLVLSGLALTASVVGLAVATPVFLIFSHVHVPAALLIRTDVMGLLTSGALGLGGLSSLKCLAHTARQAFQRTPDYVEEAHRMMA

SEQ ID NO: 35968 - DNA, 635 bp, Zea mays
  misc_feature: Ceres CLONE 1418607-F
  misc_feature: Encodes the peptide sequence at SEQ ID NO. 35969
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgccctcaacttcgacctcttcaagctgctgcggccgactggcgcgacacgctcttctgcg

SEQ ID NO: 35969 - protein, 163 aa, Zea mays
  misc_feature: Ceres CLONE 1418607-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFALNFDLFKLLRPTGATRSSA

SEQ ID NO: 35970 - DNA, 652 bp, Zea mays
  misc_feature: Ceres CLONE 1418610-F
  misc_feature: Encodes the peptide sequence at SEQ ID NO. 35971
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaaacaaggagcactcattgcctccccatctcgtgtaggctctccccctcctccacgctccgtccgtctctcatcaccgttccgccgccgccccacctctccctcctctcgccgccgcctccgaacccgccacggcgcggcggagatccaaccggacggatctggatcgacctactccgacaccgctttccgaagatagatagatagataacaaggttgtgctgtgcttgctgtctgttgggaagtggaggaagctcaataagttgatatccgcctcgagctcgagggaaccggtgggcagggcccccccgatcacgagcatggacagaactgccaataatgcggtattggatatcgagagccttcctcaaccgcctgataaatgctgctctgggagtccgaaaatgatcagggccttgtcgcgtaagggttcgaacccgatggagaggagggcggctgccgccgccaacatgaacaagaagatttggngaaaaaactttgcatcaaagttgtgccgtcctcactggagcagcaaccccttgggtcagaccag

SEQ ID NO: 35971 - protein, 77 aa, Zea mays
  misc_feature: Ceres CLONE 1418610-F
  misc_feature (57)..(57): Xaa is any aa, unknown, or other
MDRTANNAVLDIESLPQPPDKCCSGSPKMIRALSRKGSNPMERRAAAAANMNKKIWXKNFASKLCRPHWSSNPLGQT

SEQ ID NO: 35972 - DNA, 710 bp, Zea mays
  misc_feature: Ceres CLONE 1418620-F
  misc_feature: Encodes the peptide sequence at SEQ ID NO. 35973
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaaatacctctgcccttccccggtcctctccactttccggcctccgcttcccaccccgatcatcctgccgcagtgccgctccttccctccctctacccgtcgccgctgctgccatggacgaagtcgtcagccagattttggagaagcaagtgctgtctgccgcgaaggcggtggaggacaagctcgatgaggagatcgccgcgctcgaccgcctcgatccggacgacatcgaggcgctccgcgagcgccggatccagcagatgcgccgcgccgccgagcgccgcgccaagtggcgtgcgctggggcacggggagtacaccgaggtccccgagaaggagttcttctccatcgccaaggccagcgagcggctcgtctgtcacttctaccgcgacaactggccctgcaaggtcgtggacaagcacctgtcggctctggcaaaacagcacgtggagacacggttcgtgaaggtccacgccgagaaggcccccttcctgacagagagctcaggatagtcgtcctcccgaccctcgccatagntaagaacgcaaggtcgaagactactggtccgctttgaacaactcggcggcaaaggacaacttcgccacgaggac

SEQ ID NO: 35973 - protein, 132 aa, Zea mays
  misc_feature: Ceres CLONE 1418620-F
MDEVVSQILEKQVLSAAKAVEDKLDEEIAALDRLDPDDIEALRERRIQQMRRAAERRAKWRALGHGEYTEVPEKEFFSIAKASERLVCHFYRDNWPCKVVDKHLSALAKQHVETRFVKVHAEKAPFLTESSG

SEQ ID NO: 35974 - DNA, 650 bp, Zea mays
  misc_feature: Ceres CLONE 1418627-F
  misc_feature: Encodes the peptide sequence at SEQ ID NO. 35975
aaagctggagctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctggaagctccagttgttgttgttacaggtgcctctagagggattggaaaggcaactgctctagcccttggaaaagcaggatgcaaggttctggtaaattatgctcggtcttcgaaagaggctgaagaagtctccaaagagattgaagcatctggtggtgaggctatcacctttggaggagaatgttccaaagaagctgatgtagagtctatgatgaaa

SEQ ID NO: 35975 - protein, 142 aa, Zea mays
  misc_feature: Ceres CLONE 1418627-F
  misc_feature: SWISSPROT Homolog: EC 1.1.1.100 3-oxoacyl-[acyl-carrier-protein] reductase
MAAAAAAAAAVSSPIAPRAVAAAASRRGFVTFGGGAARSSPTLRSGRGFSGVQTHVAAVEQAVVKDATKLEAPVVVVTGASRGIGKATALALGKAGCKVLVNYARSSKEAEEVSKEIEASGGEAITFGGECSKEADVESMMK

SEQ ID NO: 35976 - DNA, 649 bp, Zea mays
  misc_feature: Ceres CLONE 1418628-F
aaagctggagctccccgcggtggcggccgctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcactagcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccgtcctggatctgttgcgcgagagcgcggcagcgcgcgagattcggccccttctcttctcctaggaagcaggaagcaagccgaccgctcgctgagcggcgccgccgatggccgtcgcgggggccatgaagctcttggaggtgggagaccgcggcaagggccgccgccccggggcccgacgaccccctggcgcg

SEQ ID NO: 35977 - DNA, 721 bp, Zea mays
  misc_feature: Ceres CLONE 1418638-F
  misc_feature: Encodes the peptide sequence at SEQ ID NO. 35978
  misc_feature (474)..(474): n is a, c, t, g, unknown, or other
aagctggagctccccgcggtggcggccgctctagaactagtggatcccccgggctgcaggaattcgcacgagaccattacctagaacatcctaatcgaaaaggtctaggccatggccatgtccgcttcctcctcctcgcgcgccctcctccgccggatcggcggcgcgctcctccgccgctccttctcctcctcatccgccgccgccgccgcagggtaccacgtcgcgggcgggcccagctacatgcgcggcgccgtcttctgggagcccggccgcccgctcacgctcgaggagttccgcatgccgcgccccaaggccggcgagctcctcatcaagaccaaagcctgcggggtctgccactccgatctccatgtcctcaaaggcgagctccctttctccacgccctgtgtcgtgggccatgagatcactggagaggtggttgaccatggcacgcacactcctgctgagatcatncacaggttcccagtcggaagtcacgtcgtcggcgcctttcatatgccatgtgggaactgcttctactgcgttaaggggcaagaagatctgtgcgagtcttttctcgcgtataatcgtgccagggggaccctctatgatggcaagacccggctgtttctaagagccatgggaaacggtgtacctgtatagtattggagggcttgccgagtattgtgttgtcccaccaatggcctagcagttctcccta

SEQ ID NO: 35978 - protein, 183 aa, Zea mays
  misc_feature: Ceres CLONE 1418638-F
  misc_feature (69)..(183): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (121)..(121): Xaa is any aa, unknown, or other
MAMSASSSSRALLRRIGGALLRRSFSSSSAAAAAGYHVAGGPSYMRGAVFWEPGRPLTLEEFRMPRPKAGELLIKTKACGVCHSDLHVLKGELPFSTPCVVGHEITGEVVDHGTHTPAEIXHRFPVGSHVVGAFHMPCGNCFYCVKGQEDLCESFLAYNRARGTLYDGKTRLFLRAMGNGVPV

SEQ ID NO: 35979 - DNA, 751 bp, Zea mays
  misc_feature: Ceres CLONE 1418639-F
  misc_feature: Encodes the peptide sequence at SEQ ID NO. 35980
ccccgcggtggcggccgctctataactagtggatcccccgggctgcaggaattcgcacgagaccattacctagaacatcctaatcgaaaaatatacctcctcaaggcacgttcaccacagtcctctctttccccggcaccaccaccaccacccaggctaacaggactggaccgagtgttgaacaacactgcagtgagcgacggcaggcatggtgagccgtgaaaatttgcacctggtgctggacccggcgtctctgggcgctccttgggccgacccgtccgccgcatagatcccgccgcagctcctcgccgcgctgggagagtacctctcctccgcccgcggcgacgtctagacggaggcggacgaccagttcatgatgcacgacttcaaggtgcggcggtgcgcgcgcgcgcggagacactactggactgcgtgcccctacccgcaccctggggaggccgcgcgccagcgggacccgcacctcgtggactacgcaggggagccgtgccctgacttccggaaccccccgggcccgggcgcctacgtgcccctcgcggggtcgcctggccgagtcccgcactggaacctactaagttttggctccagcccccccctgctccgcaaagcgccccctgcccaattgggaccaatgactgcctacttcccatttcagtcttcttatctcgcaaaacttaatgtcctaactatattcactctaacaccctgggcctgcctatgggaagggaggact

SEQ ID NO: 35980 - protein, 126 aa, Zea mays
  misc_feature: Ceres CLONE 1418639-F
MMHDFKVRRCARARRHYWTACPYPHPGEAARQRDPHLVDYAGEPCPDFRNPPGPGAYVPLAGSPGRVPHWNLLSFGSSPPLLRKAPPAQLGPMTAYFPFQSSYLAKLNVLTIFTLTPWACLWEGRT

SEQ ID NO: 35981 - DNA, 702 bp, Zea mays
  misc_feature: Ceres CLONE 1418647-F
  misc_feature: Translation starting site: 203
aaagctggagctccccgcggtggcggccgctctagaactagtggatcccccgggctgcaggaattcgcacgagaccattacctagaacatcctaatcgaaaactatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcagcctcgtcgaccacctccagtagcggctcggcgtcaccgccgcgtccttcgcgccggccgccgtcgtcgctgcgcccaggacgggcggctgggtcgcggtctaggaagatgcccccgtccacgagacggagttcgacgtgatgatcgaagaagtgccccgcagcgcgcgtatcgccactatcaaggaggtgcgcgcgcatcccattcctcgcgctcaaggaggccaaggaccttatcgagggtctccccaggatgtccagggagccctcaacaaggcccaggccga

SEQ ID NO: 35982 - DNA, 641 bp, Zea mays
  misc_feature: Ceres CLONE 1418651-F
  misc_feature: Encodes the peptide sequence at SEQ ID NO. 35983
  misc_feature (471)..(471): n is a, c, t, g, unknown, or other
ggagctccccgcggtggcggccgctctagaactagtggatcccccgggctgcaggaattcgcacgagaccattacctagaacatcctaatagaaaactccccagcccccgccccggtcgcggagccgtcgttctcgtctttcggtactcgcgcgcgccagctcacttctctacttcccttccccagatctacctccattcttccctcaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgagtgagttctgatttaccgagtcgtcattccctgtgctggntgaagttgttggatttgatgtggtgccccgcgtgtgttgcagcattgggattcaaacgtgaggacgtgcagtacaacaacatcaagttccaagtatgggatcttgggtggtcaaacaagcatcaggttaccggttctttatcatgatagaaaattcctgactgccatttc

SEQ ID NO: 35983 - protein, 50 aa, Zea mays
  misc_feature: Ceres CLONE 1418651-F
MGIVFTRLFSSVFGNREARILVLGLDNAGKTTILYRLQMGEVVSTIPSEF

SEQ ID NO: 35984 - DNA, 736 bp, Zea mays
  misc_feature: Ceres CLONE 1418662-F
  misc_feature: Encodes the peptide sequence at SEQ ID NO. 35985
  misc_feature (709)..(709): n is a, c, t, g, unknown, or other
aaagctggagctccccgcggtggcggccgctctatactaaaggaggccccgggctgcaggaattacaacgagagcgttacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgctccgccacgagggccagccgtgggagacccaggaatgcatgaggcggtgccgccgccgcggactggccgtcgacatggagcaagagtactgtcgcggcagcaagagcgcgggcaagtgccgggagaggtgcgagcgccaccaccgcggggactggtgggagaggcagcgctgcctgatggatgaaaaaaccnggggatgtggtaagatgaagcccccca

SEQ ID NO: 35985 - protein, 174 aa, Zea mays
  misc_feature: Ceres CLONE 1418662-F
  misc_feature (166)..(166): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLLRHEGQPWETQECMRRCRRRGLAVDMEQEYCRGSKSAGKCRERCERHHRGDWWERQRCLMDEKTXGCGKMKPP

SEQ ID NO: 35986 - DNA, 556 bp, Zea mays
  misc_feature: Ceres CLONE 1418663-F
  misc_feature: Encodes the peptide sequence at SEQ ID NO. 35987
  misc_feature (386)..(386): n is a, c, t, g, unknown, or other
ctggagctccccgcggtggcggccgctctagaactagtggatcccccgggctgcaggaattcgcacgagaccattacctagaacatcctaatcgaaaagtggattgtactgttctcagtggattaatagaattggacgctggagatagacccgccggagaagatggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctctttctcctcgctaccgccgccgccgccggaagcaacaaggctgaangagtggacgacctccagtacccttattgacaactcccaaagacatcccacccccacgaccccttgacgggttggcccttaaaggccggccgcgggggggttagactacaaaaaaacaacccttttttctttccaagaataccggggccccgggaacccccccccaaaaat

SEQ ID NO: 35987 - protein, 40 aa, Zea mays
  misc_feature: Ceres CLONE 1418663-F
  misc_feature (32)..(32): Xaa is any aa, unknown, or other
MGSTRTSHPSFPVLLLFLLATAAAAGSNKAEXVDDLQYPY

SEQ ID NO: 35988 - DNA, 635 bp, Zea mays
  misc_feature: Ceres CLONE 1418667-F
  misc_feature: Encodes the peptide sequence at SEQ ID NO. 35989
aagctggagctcaccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggacatgggagaatggtgcttcaagaaacgcgcagctctggtgattattggggccattattagctcgctgcagctgctcctgataactgctcaagaagctggaggagaccacgaggtgtggtcgtcgtcatcctcgccggccggtggtcgtggtggcggcgccgtcgtcatctcaactgcgcagatggagactgacgggtcgtcttcgtgttctggggaggaggccgtggtggtgtaccagagcatcgccaagcctctgcccagcggcaatccggactacatcgtgcagatcatcaacctcagctgttgacggtgcaacctgtaagacatgcaggtttcctgcggcgacttccccaccacggaggtcgactacccggccaagttccggcgagtccccttcaaacaatgatttgtccagggcggcgccccctttgggacccgccag

SEQ ID NO: 35989 - protein, 101 aa, Zea mays
  misc_feature: Ceres CLONE 1418667-F
MGEWCFKKRAALVIIGAIISSLQLLLITAQEAGGDHEVWSSSSSPAGGRGGGAVVISTAQMETDGSSSCSGEEAVVVYQSIAKPLPSGNPDYIVQIINLSC

SEQ ID NO: 35990 - DNA, 742 bp, Zea mays
  misc_feature: Ceres CLONE 1418668-F
  misc_feature (353)..(353): n is a, c, t, g, unknown, or other
aaagctggagctccccgcggtggcggccgctctagaactagtggatcccccgggctgcaggaattcgcacgagaccattacctagaacatcctaatcgaaaacaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccngcgccggtccacctgcccaccgccggtcatgtgccgcccgccgttcatctggcgccgcccacatgccactaccctactcaaccgccccggcctcagcctcatccccagccacacccatgcccgtggcaacagccgcatccaagcccgtggcagtttgagggaacctggcgggtttggagcccccccattcctgggccagtgcctccagttcctggaggattaagtggacccgaaggggaaccccttatgttccccttaaggccaatttttgcggaaaagttttccccccctccccggggggggggaacccccacccccggtcccggggaaattccgggtggggcccccccccccctctcggaaaaaccccccaaaggggccgggcgggg

SEQ ID NO: 35991 - DNA, 645 bp, Zea mays
  misc_feature: Ceres CLONE 1418676-F
aagctggagctccccgcggtggcggccgctctagaactagtggatcccccgggctgcaggaattcgcacgagaccattacctagaacatcctaatcgaaaacccgggatcctcgttttgtttcccttcccccacccttcctcttcctccctatctatcagcactgctcgccggcgccgcctctgcaaaaggctcacttttgcctccggaacccagcggaatccgccggcggaccggaaacactcgctcgcccccctcaccccctgtctgcccggccgtcggagcgcgtcgcctcctggcgtgcagcagcagtccgtggaagtggagccccggaggaggaggaggaaggacaaggaccaggcattaatctggccgaaaagccggaacaccaaggagtggggctgcctccccctccgcccttggaacccaaaacctaccggaattggccctttgcccccggccccccgcaaaaaaaggggggatctttttgggagggggaaaaaaaaaaaaagggtgttctctttttttttaaaaaaaaaaaaaccccctcctccccctgagaagaaacttccttcccccacaaccctttctttttttcttttcctttttggaaaaaaaaaaaaaaaaaaggggggctcttcttctt

SEQ ID NO: 35992 - DNA, 887 bp, Zea mays
  misc_feature: Ceres CLONE 1418679-F
  misc_feature: Encodes the peptide sequence at SEQ ID NO. 35993
  misc_feature (887)..(887): n is a, c, t, g, unknown, or other
ggtggggggctgttcgggggcggccgggggaaggcttttcacctttccggaagctggagctccccgcgggtggcggccgctctagaactagtggatcccccgggctgcaggaattcgcacgagaccattacctagaacatcctaagcgaaaatctatcggactcgtagtcgtagctcaagcatcagcggctggagctctgggcagcgtgcgcacgtggggtacctagctcgctctgctagcctaccatgggctgatcacctccgggggggcgacgggaagtggcgggggctactgctgacctcttgcgcggggggcggcatgcacggcgagccgcagcagcgagcagaaggaggggcgccatgatggtggcgctcaagggccgggacggccgcgaccttgcggcggggccgatgtctggttgctgttcgtggcctgcaccctgtgccggggggcgggggatctcgcgtcccggtggcgcaccgcccaggtttggggaaccttcagcccggggggctcgggtgtcggggctgctgggtgctgtggggggttcatgtgaagggctcgggtgtcgacggttggtgcagtgtagagcggcgatggtgtgtggaatgtcgtgtgtggtgtgtcttcgctgcccgagggtgtgcccggcggaggctggagcggtgaacgttgggggtgacctcgaggacggtggtgttatgcggctctgctgctgagtgtgtgtgggtgggggggctgtgcgtggtcagcgggttgacctggcggcgctgcggttactcgcaggctgtcggtggtcaccgactcacggacgctgagcgtctcttttgggtcgtgggtgttgagtgtttgtggtcgatcgttctggtggtgcgactgttcgtcn

SEQ ID NO: 35993 - protein, 44 aa, Zea mays
  misc_feature: Ceres CLONE 1418679-F
GGGLFGGGRGKAFHLSGSWSSPRVAAALELVDPPGCRNSHETIT

SEQ ID NO: 35994 - DNA, 738 bp, Zea mays
  misc_feature: Ceres CLONE 1418686-F
  misc_feature: Encodes the peptide sequence at SEQ ID NO. 35995
aaagctggagctccccgcggtggcggccgctctagaactagtggatcccccgggctgcaggaattcgcacgagaccattacctagaacatcctaatcgaaaaacgaatattctctctagatgccgcatcatcccgtccgcgaacgtcgccgtccgggacggagcgcctcgctcgcaacccacccctcctctctcggcgactcggttctccctcccgcgggacgccaccggagctgactgccgctgctggggcctggccgttctctcatggtcatggagacgccttcgcaggagatggacccagagcaacatggggacaacatggcaggcaagggtggagctggacaggtctattggtccaacgcaatgtctagttttgtgctcaaatatttggccgacctagttgcgagtggaactaaaatcacgagcggcttcaagcaagctcatcttaacagctgtgctagagctttgtatgagaagctaggtgtccagcgcaccggcggacaagtcggcaaccatctcaggaagtggaaaaggatttatgcgaagatcgagaagctgaagaacctggatggagctgtctgggatgaacataattgcgtaatcagtcttgacgcagagcattacaataaccatattaaggaccaccgtgaggatgccaactacttgaacattccggtcgagcattatcatgagatggccattatatctggcaacagttcggcaaccgctgctgcat

SEQ ID NO: 35995 - protein, 157 aa, Zea mays
  misc_feature: Ceres CLONE 1418686-F
MVMETPSQEMDPEQHGDNMAGKGGAGQVYWSNAMSSFVLKYLADLVASGTKITSGFKQAHLNSCARALYEKLGVQRTGGQVGNHLRKWKRIYAKIEKLKNLDGAVWDEHNCVISLDAEHYNNHIKDHREDANYLNIPVEHYHEMAIISGNSSATAAA

SEQ ID NO: 35996 - DNA, 626 bp, Zea mays
  misc_feature: Ceres CLONE 1418687-F
  misc_feature (238)..(238): n is a, c, t, g, unknown, or other
aaagctggagctccccgcggtggcggccgctctagaactagtggatcccccgggctgcaggaattcgcacgagaccattacctagaacatcctaatcgaaaaattcacaacttcagctgcgcctcgactcgtagcccgaaccctagccaccaagccggaggcgagagagcagccatggcgcggtgcctcgcgctcgtcgcccctctcgtactcgggctcggcggcgccgccgcttcgngggcgaagccgccttcgtcgtcgggcaaaaaaagatttcgctctccccccccaagccgggggtttaagggggttcccctttccggtgaaacttttaaaacaggggttccccgaacggccctttaaagggggccttaaaagaccaacctttgggcccaaaaaaaagttttttaaccttttctcccggggaaaaaaaactcaaaaaatttttaaaaggggtttgcccctgggggccccgttttttaaaaaattttttttctggggaaaccaaaaaaacgggggggggggcccgggggttcccccatatttttaaaaaaacccggggccccacaaaaaaaacctttttggggggggaaataaacacccccccttccccccgggaaattttg

SEQ ID NO: 35997 - DNA, 748 bp, Zea mays
  misc_feature: Ceres CLONE 1418689-F
  misc_feature: Encodes the peptide sequence at SEQ ID NO. 35998
aaagctggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaagggccttagcacccgagagatcgacgaagcctttccgaaggtttcctgatcctcaacccagcactacggctaccacttctccgcagcagcaggtcaacagccagaaatcaatccgtccggggtgaagccttatgccccagcccaaccttgtgcacccagcaaacgttgggcctgttgttccttcaacgcaacccaagttttagttggacccaaaattccctgggttgcggggctcctggctgggttttgggggccacccccccggtgctttttaaaaaaaatgtcccttcaagggcccaatttttgggaccccaattgttttcacaaaaaggtttggcgcctataagggcaccccccttaacccccaagat

SEQ ID NO: 35998 - protein, 84 aa, Zea mays
  misc_feature: Ceres CLONE 1418689-F
MASGIGSGQQQPPAPAADADPGAVGDKLVFEAPPQPVREDYVQNAVKFLSHPKVRGSPVVYRRSFLEKKGLSTREIDEAFPKVS

SEQ ID NO: 35999 - DNA, 631 bp, Zea mays
  misc_feature: Ceres CLONE 1418694-F
  misc_feature: Encodes the peptide sequence at SEQ ID NO. 36000
aaagctggagctccccgcggtggcggccgctctagaactagtggatcccccgggctgcaggaattcgcacgagaccattacctagaacatcctaatcgaaaaaggtagctgagcgaagcatccggtgtgttccctcgccatccgccgccgccgccatgccgggcttcgctcagcgtctcgcgggcatcccgtggcggagcatcgcgaggcaaggcctctcccgcgtgttcctggtggcgaaggcctactgcgtgatccacgtcgtcaacgaccacctctgctcggtgaccttagtgcggggcgccagcatgctgccgtccctgaacctggcgggcgacgcggtggcggtggacagggtcagcgtgaggctcggccgggtcgcgccgggggacatcgtgctgatgatctcccccgaggacccgcgcaagtcggtcgtcaagcgcgtcgtcgggatgcagggggactccgtcacctaccttgtcgaccccggcaaaagcgactcctccagaaccgtcgtggtaccgcaagatcatgtctgggtgcagggggacaatatctttgcttctaacgattcgaggcaatttggagctgtgccttatgggctgattacagggaagaacttttgccgggt

SEQ ID NO: 36000 - protein, 158 aa, Zea mays
  misc_feature: Ceres CLONE 1418694-F
  misc_feature (46)..(125): Pfam Name: Peptidase_S24 Pfam Description: Peptidase S24-like
  misc_feature: SWISSPROT Homolog: EC 3.4.21.89 Signal peptidase I
MPGFAQRLAGIPWRSIARQGLSRVFLVAKAYCVIHVVNDHLCSVTLVRGASMLPSLNLAGDAVAVDRVSVRLGRVAPGDIVLMISPEDPRKSVVKRVVGMQGDSVTYLVDPGKSDSSRTVVVPQDHVWVQGDNIFASNDSRQFGAVPYGLITGKNFCR

SEQ ID NO: 36001 - DNA, 634 bp, Zea mays
  misc_feature: Ceres CLONE 1418696-F
aaagctggagctccccgcggtggcggccgctctagaactagtggatcccccgggctgcaggaattcgcacgagaccattacctagaacattctaatcgaaaactctcgtctcgtctcgtcggcagtagcagtctccgcatccgctgcctccgcctcctccggcgatttggattcacggcgggggcggtggccaatcaaagcaataataacccaatcgaccaggccaacgaacgctccaagccccaggactcccacccgcctcgatcgatgcaagggacagatgccggacaccgactcctccacctcctcctccgactcgccggcggcggtgccattgtcatcgatgtgacgctccagtccgatcgctccgcccagaccagaaccagatccactgcttcccgcctccacgagaatccatgtacgacttccagcgcagctgggacaaaatcctggccgacatcacggcagacgactacctcctctgacgagcgtggaggcgccgaacaccgcgaatcctgcctcctctgcctcgaggagttctgcgacctgttgctcggatgcggtgacgtcacatgtgctctacccacgttagattgtctcgaagccgacttctccgaccgtgcacggcagcgaa

SEQ ID NO: 36002 - DNA, 680 bp, Zea mays
  misc_feature: Ceres CLONE 1418704-F
  misc_feature: Encodes the peptide sequence at SEQ ID NO. 36003
  misc_feature (360)..(360): n is a, c, t, g, unknown, or other
  misc_feature (375)..(375): n is a, c, t, g, unknown, or other
  misc_feature (486)..(486): n is a, c, t, g, unknown, or other
  misc_feature (534)..(534): n is a, c, t, g, unknown, or other
  misc_feature (536)..(536): n is a, c, t, g, unknown, or other
aaagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggngccgctccccgcttncctcacgccctggctctggctcttcctctgcctcctcgctgcgccgtgcccccgcgcgcgggcggcgccgttcccgtgcaacgccacgcggcgcgagcgtccactggcaanggctcgtctctaacggcgcccaaggggacggcaacccccccctggccncntgggggggttctttcaggttcgttcccacccgggggtgttgggcccccaaaggtttcccgttttccaaccggccaagggggcccgggcccctggcctttggggggccccctggcctggcctttgtttggggggggccccgggcc

SEQ ID NO: 36003 - protein, 47 aa, Zea mays
  misc_feature: Ceres CLONE 1418704-F
  misc_feature (2)..(2): Xaa is any aa, unknown, or other
  misc_feature (7)..(7): Xaa is any aa, unknown, or other
  misc_feature (44)..(44): Xaa is any aa, unknown, or other
MXPLPAXLTPWLWLFLCLLAAPCPRARAAPFPCNATRRERPLAXARL

SEQ ID NO: 36004 - DNA, 823 bp, Zea mays
  misc_feature: Ceres CLONE 1418722-F
  misc_feature: Encodes the peptide sequence at SEQ ID NO. 36005
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
nttttttnnnnnnnnnnnnntttggcctccctcgtccgtcataaaaaattttcagagctggactccaccgcggtggcggccgctctagaactagtggatcccccgggctgcaggaattcgcacgagaccattacctagaacatcctagtcgaaaatcccacaccaaccctctgtgcctcggtccctccgcccgtacgcgcgacgagagacacgatgcggcggtccctaccccttctcctcgcgcggcaggtggcgcggcggctgcggctgatcaacgtgccggagtccaccgtctacgggggcccacgcccgcaggagtcctcggcggcgcggcgcgtgacggtgaccacactccgtgggaagcaccgccgtcggggagcctatcacccgtcgtcacctccttacgactacccctacggcgtgtccacgtccgactcccgccggtgatcggacgtctgtcctcgctcgcgggactccccccgcccatgggtcgggcgccgggccacgaagaacccggcttcccccattcaacgcttcgaacaatcattggctccgaagcacctggcactagtccattggggacccgggggcccccgttccgcgggccccggcgtccgtcgggtcggggggattctccccaatttccggcttgccatcaaagctcccccccgcccgccccagggctggttcgaatatccgcccccggtagggctccctcccaaggaaaaggcgggaacagggagccccgaaccaatccccggtaaagggggctggcctcacgcggagggcatccacaggtatggccaacatgcttatttgctga

SEQ ID NO: 36005 - protein, 77 aa, Zea mays
  misc_feature: Ceres CLONE 1418722-F
MRRSLPLLLARQVARRLRLINVPESTVYGGPRPQESSAARRVTVTTLRGKHRRRGAYHPSSPPYDYPYGVSTSDSRR

SEQ ID NO: 36006 - DNA, 646 bp, Zea mays
  misc_feature: Ceres CLONE 1418726-F
  misc_feature: Encodes the peptide sequence at SEQ ID NO. 36007
  misc_feature (646)..(646): n is a, c, t, g, unknown, or other
ggagctccccgcggtggcggccgctctagaactagtggatcccccgggctgcaggaattcgcacgagaccattacctagaacatcctaatctaaaaaaaaaactagcgcttactgttttgcacggccatagtctcgatccccaccgagtccagcaaacagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgtcgcagcactatcacccgccctccacctccgacggcgacgatgaggtcgaagaagacgagggaagcatggacgacggcagcgccgaagaagatgatgccgagctgtccgacggaagggctctcggctcggcgcggcgacgcgccttctccggctcaagtggaacaagggtttgcgcagaggctttcaagtattggacgtatggagataaatgggggaaatggagtgaagtcaatccaagaagggcagcaatggcatttattgtaccatggaatcgagattgggcctccattcacgaggaggggatggaactgggaacatccccan

SEQ ID NO: 36007 - protein, 148 aa, Zea mays
  misc_feature: Ceres CLONE 1418726-F
MASPAGANSGASSSRGTPLPLPFPFPAAAHFPSRGAGPFLSQHYHPPSTSDGDDEVEEDEGSMDDGSAEEDDAELSDGRALGSARRRAFSGSSGTRVCAEAFKYWTYGDKWGKWSEVNPRRAAMAFIVPWNRDWASIHEEGMELGTSP

SEQ ID NO: 36008 - DNA, 642 bp, Zea mays
  misc_feature: Ceres CLONE 1418730-F
tcccccgggctgcaggaattcgcacgagaccattacctagaacatcctaatcgaaaaaccagatctcgaggcagcggagtccggggacgccgttctttccgttgtgcttcctttgcctcttgctgccggtggccggtgattttcccgaggtctgtttgggcggcaggtagaggctattttcttggcggctggtgggatggatagccacgccgccgggtcgagctccggcgggtccggggatggcggcgcgcagcccaggaggagctccaggaaacccacgtattccaagtttactcagcaggagcttccagcttgcaagccgattcttactccaaaatgggttatttcagtattcgttcttgttggcgtgatttttggtctccattggtattgtttcgctgcgagccttcccgacaagttgtcgagatcgttgatcgggatgatgattcatgtgtccctgcctggtgtgactgacaaagcttgctttacttccggtatgattggttcaccaaaaagctcgcccaaggaatctggaccgatttccaaaggatattggagccccgccgatttttgggggttttatccacgcggggtggactttttacccaaaataccataggagggttattccaaacagccccg

SEQ ID NO: 36009 - DNA, 640 bp, Zea mays
  misc_feature: Ceres CLONE 1418731-F
  misc_feature: Encodes the peptide sequence at SEQ ID NO. 36010
  misc_feature (445)..(445): n is a, c, t, g, unknown, or other
  misc_feature (446)..(446): n is a, c, t, g, unknown, or other
  misc_feature (640)..(640): n is a, c, t, g, unknown, or other
tggagctccccgcggtggcggccgctctagaactagtggatcccccgggctgcaggaattcgcacgagaccattacctagaacatcctaatcgaaaaatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgatggtgcccatcaccatcctcaagtccgctgttagcgacggagctgtgtgcatggatggaacgccacctgcttaccacttggatccctgctccnngagcggcagcagaagctggattgtgaacttagagggagtgcgtgggtgcacagcgcccagacatgccggctcaccaggagctccggccgtggctcgtcggaccacatggacaaagagatccctttcaccgcatcatgagcagcagccgtaccgtgaatcctggtctcgcccgattctaatttctacatctggan

SEQ ID NO: 36010 - protein, 151 aa, Zea mays
  misc_feature: Ceres CLONE 1418731-F
  misc_feature (87)..(87): Xaa is any aa, unknown, or other
MADRPSLPALIIAIAVLAGSYCRVASSASPAVEDELRGGGGAGGPTTMRRRAASVMVPITILKSAVSDGAVCMDGTPPAYHLDPCSXSGSRSWIVNLEGVRGCTAPRHAGSPGAPAVARRTTWTKRSLSPHHEQQPYRESWSRPILISTSG

SEQ ID NO: 36011 - DNA, 649 bp, Zea mays
  misc_feature: Ceres CLONE 1418741-F
  misc_feature: Encodes the peptide sequence at SEQ ID NO. 36012
  misc_feature (261)..(261): n is a, c, t, g, unknown, or other
  misc_feature (270)..(270): n is a, c, t, g, unknown, or other
  misc_feature (476)..(476): n is a, c, t, g, unknown, or other
  misc_feature (526)..(526): n is a, c, t, g, unknown, or other
aagctggaactccccgcggtggcggccgctctataactagtggatcccccgggctgcaggaattcgcacgagaccattacctagaacatcctaatcgaaaaaacaaacccacggactaacacacgcgcacgcgtacagcaaagaaatggcgatggcgatgcagccatcttagcccccctcccctctccctaccctccatggccgtccctcctctgctgctcgtcgccgttgccgtagccgcgctctccatcctcgtcctcntccccttcnccttccggcgatgcaggcggcggcggcaacgccacccgctgcaggccgcggcggtggccccgaccccggtcgctgtccaggatgaggacatagataggcctcttctttctgaaaatcagagcgatcactctagacagaatattagttttcttggaagttctgtaggagaaccttcgaagattcaaacaaataggagtaacacttcncctagaagtcatgcaattgctgatacagggaggatttatcctgctgaatnggtgtgtacacaaggagaaactcatgtaatcaatgttgaaaatgatacttctgaagagttccattaggaagcacactaagacgtacaccgccaccaaatggccaaacactgaccaggagcacg

SEQ ID NO: 36012 - protein, 131 aa, Zea mays
  misc_feature: Ceres CLONE 1418741-F
  misc_feature (22)..(22): Xaa is any aa, unknown, or other
  misc_feature (25)..(25): Xaa is any aa, unknown, or other
  misc_feature (110)..(110): Xaa is any aa, unknown, or other
MAVPPLLLVAVAVAALSILVLXPFXFRRCRRRRQRHPLQAAAVAPTPVAVQDEDIDRPLLSENQSDHSRQNISFLGSSVGEPSKIQTNRSNTSPRSHAIADTGRIYPAEXVCTQGETHVINVENDTSEEFH

SEQ ID NO: 36013 - DNA, 650 bp, Zea mays
  misc_feature: Ceres CLONE 1418743-F
  misc_feature: Encodes the peptide sequence at SEQ ID NO. 36014
atagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgcccgtgttcctgatcttcagccccgtgctcgtccccgccgcgctgctcatcgggacgggcgtcatggggttccctcacgtcggcgcgctggggctcggggggctgtcctcgctcacgtgcctcgccaacacggcgcggcaagcgttccagcgcaccccggactacgtggaaggaagcccaacgcaagatggccgaaggccccgcc

SEQ ID NO: 36014 - protein, 148 aa, Zea mays
  misc_feature: Ceres CLONE 1418743-F
  misc_feature (44)..(148): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTGVMGFPHVGALGLGGLSSLTCLANTARQAFQRTPDYVEGSPTQDGRRPR

SEQ ID NO: 36015 - DNA, 652 bp, Zea mays
  misc_feature: Ceres CLONE 1418746-F
  misc_feature: Encodes the peptide sequence at SEQ ID NO. 36016
  misc_feature (258)..(258): n is a, c, t, g, unknown, or other
aaagctggagctccccgcggtggcggccgctctagaactagtggatcccccgggctgcaggaattcgcacgagaccattacctagaacatcctaatcgaaaaaacaaaaaccagaccacgcggaacggcaacagcaagctgcctctctcccttgcgcgcgcgtgatttcatcttcgtccgatcccatcccaccccaccccacctcaccggagcccctctccccctaactcctccggcagctgctccgatcccgaaccngtgattcgctcgatggcggcaaccgcgggcggcaacaagatccgcaacgccaagctggttcttcttggggacgtgggcgccggcaagtccagcctggtccctcggtttgtgaaaagccagttcgtcgagttccaggaatccaccatcggcgcggctttcttctcgcagaccctggcgtgaaccacgagacggtcaagttcaagatatgggacaacgcggggcaggaaacgaaccacaagcttggctcccatgtattaccgggggccctgcggctggccaaaattgcctacgaaattcacaaaaccgggcctcttttacccctggcaaaaaaaaggggttcaaaaactttccagcccaggagaaaccccaaaacaaaaagggcgccttgcccgga

SEQ ID NO: 36016 - protein, 55 aa, Zea mays
  misc_feature: Ceres CLONE 1418746-F
MAATAGGNKIRNAKLVLLGDVGAGKSSLVPRFVKSQFVEFQESTIGAAFFSQTLA

SEQ ID NO: 36017 - DNA, 655 bp, Zea mays
  misc_feature: Ceres CLONE 1418747-F
  misc_feature: Encodes the peptide sequence at SEQ ID NO. 36018
  misc_feature (655)..(655): n is a, c, t, g, unknown, or other
aagctggagctccccgcggtggcggccgctctagaactagtggatcccccgggctgcaggaattcgcacgagaccattacctagaacatcctaatcgaaaatttttttttttttttttccccacacgcgcccacctcctccggtcctcccctctagtcctctctcccgaccccacctctgccgtccgtgcgtccgtccggcaaccgcgacgcaacaatggcggccgggcgagagctggtggtgagtttcggcgagatgctgatagacttcgtgccgaccgtggcgggggtctcgctggccgaggcgccggccttcctcaaggcggccgggggcgcgcccgccaacgtcgccatcgcggtctcgcgcctcggtggcggggccgccttcgttggcaagctcggcgacgacgagttcggccgcatgctcgccgccatcctccgcgacaacggcgtcgacggcggcggcgtcgtcttcgacgcgggcgcgcgcaccgcgcttgccttcgtcaccctgcgcgccgacggcgagcgcgagttcatgttctaccgcaaccccagcgccgacatgctcctcactgccgacgagctcaacgtcgggctcatccggagggctgcggtctttcactacggatcaataagcttgattgctgagcctn

SEQ ID NO: 36018 - protein, 146 aa, Zea mays
  misc_feature: Ceres CLONE 1418747-F
  misc_feature: SWISSPROT Homolog: EC 2.7.1.4 Fructokinase
MAAGRELVVSFGEMLIDFVPTVAGVSLAEAPAFLKAAGGAPANVAIAVSRLGGGAAFVGKLGDDEFGRMLAAILRDNGVDGGGVVFDAGARTALAFVTLRADGEREFMFYRNPSADMLLTADELNVGLIRRAAVFHYGSISLIAEP

SEQ ID NO: 36019 - DNA, 648 bp, Zea mays
  misc_feature: Ceres CLONE 1418750-F
  misc_feature: Encodes the peptide sequence at SEQ ID NO. 36020
  misc_feature (648)..(648): n is a, c, t, g, unknown, or other
ctggagctccccgcggtggcggccgctctagaactagtggatcccccgggctgcaggaattcgcacgagaccattacctagaacatcctaatcgaaaaaacagcaccccctcctcgctcgcactccgctcgtctgacatctcctcccgtcctttcctttctgaggctcgcgaaccccgacgatggccgccaccgcggtgtcggtcgacgagaagctcgacaagcttcgcgcctaggtcgccaaactcaaccagatcagcgagaacgagaagtccgggttcatcagcctcgtgtcacgttacctcagtggggaggcggagcagatcgagtggagcaagatccagaccccgaccgatgaggtggtggtgccgtacgatatcctcgcgtcacctactgaagatctcgaggagacgaagaagctgctggacaagctcgttgtgctcaagctcaacggagggctcgggacgaccatgggctgcaccggacccaagtctgtcattgaagtcccgcatgggttcacattccttgaccttattgtgattcaaatcgagtccctgaaacagaagtatggatgtaatgtccctttacttctgatgaactcttttcatacccatgatgacacacagaagatcgttgagaagtattccan

SEQ ID NO: 36020 - protein, 59 aa, Zea mays
  misc_feature: Ceres CLONE 1418750-F
  misc_feature: SWISSPROT Homolog: EC 2.7.7.9 UTP--glucose-1-phosphate uridylyltransferase
MGCTGPKSVIEVPHGFTFLDLIVIQIESLKQKYGCNVPLLLMNSFHTHDDTQKIVEKYS

SEQ ID NO: 36021 - DNA, 651 bp, Zea mays
  misc_feature: Ceres CLONE 1418760-F
  misc_feature: Translation starting site: 227
  misc_feature: SWISSPROT Homolog: EC 1.1.1.1 Alcohol dehydrogenase
  misc_feature (477)..(477): n is a, c, t, g, unknown, or other
  misc_feature (502)..(502): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttcaattnccacatgcaggcgcaacttgatctngtccccagaagtctcggccacgaagcatccggagtagtagagagtgtcggtgaaggtgtgaccgaagtccaagtcngtgacaacgtctcactgtcttcattggggaatgcaagagctgcaagcactgcgtctcaggaaagagcacatgt

SEQ ID NO: 36022 - DNA, 819 bp, Zea mays
  misc_feature: Ceres CLONE 1418764-F
  misc_feature: Encodes the peptide sequence at SEQ ID NO. 36023
  misc_feature (75)..(75): n is a, c, t, g, unknown, or other
  misc_feature (819)..(819): n is a, c, t, g, unknown, or other
ggggccggcgccgcctgtctcgttggtggtccgtcggcccctttctgtccccgcttatgggtgtgggtttggggntgacccccccgttagttggggctccccgcggtggcggccgctctataactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtcccaccagttctacagcgaagccagtaccatggtccgcgtcgacgacctcaccggcacgaccgcggctgccaacaacatgatgggaatacactcactcatcatgtctgttgagcttcacccaaattggatatcaaagactgccaaagtttggtgaactcatgggggcgatggggttgctaggttatgggtctctggggcctaggcgcagaaccagggaggtacaggcccccccaaaggcaaattttatcccagaatgttcttttccctggccccctcaaggaaaaagggtttacttttggtcccctcagacgaattaccttttccccttcggggtggaccaaaaatatacatatctccaagcctatgtcgcccacagtggatttgccttccagggaacgaacttacttaaatacccccatttttggggccctctccacacaaccaagttgtttttgtcacatcaccgcgcctctcgcgan

SEQ ID NO: 36023 - protein, 53 aa, Zea mays
  misc_feature: Ceres CLONE 1418764-F
MSSHQFYSEASTMVRVDDLTGTTAAANNMMGIHSLIMSVELHPNWISKTAKVW

SEQ ID NO: 36024 - DNA, 643 bp, Zea mays
  misc_feature: Ceres CLONE 1418768-F
  misc_feature: Encodes the peptide sequence at SEQ ID NO. 36025
aaagctggagctccccgcggtggcggccgctctataactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtttctaggactgattgcatgctcagtaccactgctacattccccaaaatcagctgctcctggcctctaaggtttaagcgcaatgatgttgttgtaagagcaatatcggaagagtgtggcccgcaggggcttcccattgatctcagaggtaaaagggcattcattgctggagttgctgatgataatggctatggatgggccattgccgaggcacttgctgcggctggtgctgaaattcttgtgggtacatgggtgcccgcactttacatatttgagacaagtctgaggcgtggaaagtttgatgaatccacgaagcttgcagatggatctcttatggatattgttaaagtccatcccccttgaggccg

SEQ ID NO: 36025 - protein, 148 aa, Zea mays
  misc_feature: Ceres CLONE 1418768-F
  misc_feature: SWISSPROT Homolog: EC 1.3.1.9 Enoyl-[acyl-carrier-protein] reductase (NADH)
MTASAAAGVQMVAARPCISASPGILTARVSRTDCMLSTTATFPKISCSWPLRFKRNDVVVRAISEECGPQGLPIDLRGKRAFIAGVADDNGYGWAIAEALAAAGAEILVGTWVPALYIFETSLRRGKFDESTKLADGSLMDIVKVHPP

SEQ ID NO: 36026 - DNA, 653 bp, Zea mays
  misc_feature: Ceres CLONE 1418769-F
  misc_feature: Encodes the peptide sequence at SEQ ID NO. 36027
gctctagaactagtggatcccccgggctgcaggaattcgcacgagaccattacctagaacatcctaatcgaaaatcctcccccctcaacaaccgcgagatcttcagctaccgctctctccggtcgcgtttgcatccgcattcctcagatccagattcgagccccagccccgcttcgagatccagctagctctctatcaagcatccggcggagcgagcagcgggaggctcggcaagagagaagatgaagcggaagacgcggaacaagatcatcgtatggacgctggccctggctgcagtggcgattctggtgggtggcacgattgcgctggtgctcacggcggggacgtggaaggccaagataaagaagtcgcaggagaagatctgtaacaaggggtgggagtgctcggggagcaagtactgctgcaacgacaccatcaccgacttcttcaaagtgtaccaggtcgagaacctcttcgcccagcgcaacacccccgtcgcggacgccggccgggttctggggactaccaagcctttcatcaccgccgggggcccctcttcgagcccccagggggttcctggcaccccccgggcgggcaagccaaatgccaaaagtgaagggagatcttttgggcccttcccctggggggggggg

SEQ ID NO: 36027 - protein, 137 aa, Zea mays
  misc_feature: Ceres CLONE 1418769-F
MKRKTRNKIIVWTLALAAVAILVGGTIALVLTAGTWKAKIKKSQEKICNKGWECSGSKYCCNDTITDFFKVYQVENLFAQRNTPVADAGRVLGTTKPFITAGGPSSSPQGVPGTPRAGKPNAKSEGRSFGPFPWGGG

SEQ ID NO: 36028 - DNA, 661 bp, Zea mays
  misc_feature: Ceres CLONE 1418772-F
  misc_feature: Encodes the peptide sequence at SEQ ID NO. 36029
atagctggagctccgcggtggcggccgctctagaactagtggatcccccgggctgcaggaattctcacgagaccattacctagaagatcctaatcgaaaaaaccgacttccagttccactctcgcttccttccctccctccctcccacgcaaatggtggccgctcgcctccgcctcgcgctgctactctccgtctgcctctgctccgcgtgggcgcgcccacgcctcgagacggccatccgcctgccgtcgcagcgcgcggcggcggccgacgaaacggacgacggcgccgtcgggacccgctgggctgtgctcatcgcaggctccagcggctactacaactaccgccaccaggcggacatctgccatgcataccagatcatgaagaagggcggactcaaggatgagaacatcattgtcttcatgtacgatgacatcgcgcatagcccggagaatccgaaggctggtgtcatcatcaaccatccccagggtggcgacgtctatgctgggggggcaaaagattacactggggcgagatgtcaacgtcgaccaatttcttcgctgttctgccttgcaaacaaaactgcttctcaggggtgggaacggcaaaggtgtggaaacgtggcccccgaaggatcaaaaccttggttttctaaagtgga

SEQ ID NO: 36029 - protein, 169 aa, Zea mays
  misc_feature: Ceres CLONE 1418772-F
  misc_feature (50)..(168): Pfam Name: Peptidase_C13 Pfam Description: Peptidase C13 family
  misc_feature: SWISSPROT Homolog: EC 3.4.22.34 Legumain
MVAARLRLALLLSVCLCSAWARPRLETAIRLPSQRAAAADETDDGAVGTRWAVLIAGSSGYYNYRHQADICHAYQIMKKGGLKDENIIVFMYDDIAHSPENPKAGVIINHPQGGDVYAGGAKDYTGARCQRRPISSLFCLANKTASQGWERQRCGNVAPEGSKPWFSKV

SEQ ID NO: 36030 - DNA, 666 bp, Zea mays
  misc_feature: Ceres CLONE 1418778-F
  misc_feature: Encodes the peptide sequence at SEQ ID NO. 36031
ggagctccccgcggtggcggccgctctagaactagtggatcccccgggctgcaggaattcgcacgagaccattacctagaacatcctaatcgaaaaatcacacatattattgagaccaactagcaacataaaaagcacaatagtgtaccaacaatggcagccaaaatattttgcctccgtatgctcattggtctttgtgcaagtgctgctacggcgactattttcgcacaatgctcacaagcacatatagcttcccttcttcccacgtacatctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattgccacaaaacatcagggcacaacaactacaacaactagtgctagcaaaccttgctgcctactctcagcaacatcaatttcttccattcaaccaactagctgcattgaactcagattcttatttgcaacaacaacaactaccattaagccaggtatatgctgcctacccccagcaatttcttccattcaatcaactgacagcattgaactctccatgatatttacagcagcaacaactactacca

SEQ ID NO: 36031 - protein, 161 aa, Zea mays
  misc_feature: Ceres CLONE 1418778-F
MAAKIFCLRMLIGLCASAATATIFAQCSQAHIASLLPTYISPAVSSVCENPILQPYRIQQAIAAGILPLSPLFLQQSSALLQQLPLVHLLPQNIRAQQLQQLVLANLAAYSQQHQFLPFNQLAALNSDSYLQQQQLPLSQVYAAYPQQFLPFNQLTALNSP

SEQ ID NO: 36032 - DNA, 677 bp, Zea mays
  misc_feature: Ceres CLONE 1418781-F
  misc_feature: Translation starting site: 201
aaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgcccttcgtgggcggcaacatcaccctgttccgggggctcctgtactgggtggcgcagctgctggggtccaccgtggcgtgcttcctgctccgcttctcgacgggcgggcaggccacgggcacccttcggctgacagggctgtcggtgtgggaaggcctggtgccggaatcctgatgacccttcggctggggtaacacggggac

SEQ ID NO: 36033 - DNA, 500 bp, Zea mays
  misc_feature: Ceres CLONE 1418785-F
  misc_feature (165)..(165): n is a, c, t, g, unknown, or other
  misc_feature (495)..(495): n is a, c, t, g, unknown, or other
  misc_feature (498)..(498): n is a, c, t, g, unknown, or other
aaagctggactccccgcggtggcggccgctctagaactagtggatcccccgggctgcaggaattcgcacgagaccattacctagaacatcctaatcgaaaaaaggatccaccacaacagcgaagggagaaagcagaccaacctagccacccagggagaaagaggnccaaaagggaggggagagtgtcgtcatggccttcccattggtcgctttcccaggaagggcccgttccttctagttccgcgcctcctgggaaaaaaggttattccgaagcggtcctccgcttcccggggactgggctcccccccttcagggcccggggggcaatttcccccgggggggccttccccggtttataaaaaaaccggggggtcccccctttctccaaacttttcccagggggggggccccaaaattcccgaaaaaaaaaaaataaagcgccccccccccccaaaatataaaaataatagggggggggcggcgccccaccccccncgngg

SEQ ID NO: 36034 - DNA, 690 bp, Zea mays
  misc_feature: Ceres CLONE 1418787-F
atagctggagctccccgcggtggcggccgctctagaactagtggatcccccgggctgcaggaattcgcacgagaccattacctagaacatcctaatcgaaaaacctcccatttggtttggcaccctataaagtaaggggtgacaaaagatggctccaacgaccgccaccaatgacgtacgtggatacagcgactagttgcggttctagctgtttgcgttcgaccacacgaagctggcgttgaaacgtctggtggactccctcctcaagtccatcccgtccatcttccaccacccgccggatgccctgaccgacataatttctccggggcctctgccgtcgtccccaccctcctgggccgccatccctgtggtggacctctcggtgactcgccacgaggacctatgcgagtatgtgcgtacgcagactggaccgtgggcttcttctggctgtgtaccacatcatggagccacatctgatgggcgaactgttccacgtagtgcgccgttcaacaagttgccccctagcacgctagcactgggctctactccatgggaccctggctaagcaacatgggcttcaacttcttaattccaactctctttaaaggacctattgcatggcggaattgcctgccacaccgactctttcatgcaaaggttgcgctccaaaacccccctccgccggggggg

SEQ ID NO: 36035 - DNA, 701 bp, Zea mays
  misc_feature: Ceres CLONE 1418788-F
  misc_feature: Encodes the peptide sequence at SEQ ID NO. 36036
  misc_feature (445)..(445): n is a, c, t, g, unknown, or other
  misc_feature (570)..(570): n is a, c, t, g, unknown, or other
  misc_feature (638)..(638): n is a, c, t, g, unknown, or other
  misc_feature (639)..(639): n is a, c, t, g, unknown, or other
  misc_feature (675)..(675): n is a, c, t, g, unknown, or other
ggagctccccgcggtggcggccgctctagaactagtggatcccccgggctgcaggaattcgcacgagaccattacctagaacatcctaatctaaaaaaaaaactagcgcttactgttttgcacggccatagtctcgatccccaccgagtccagcaaacagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgtcgcagcactatcacccgccctccacctccgacggcgacgatgaggtcgaagaagacgagggaagcatggacgacggcagcgccgaagaggatgatgccgagctgtccgacggaggggctctcngctcgccgcggcgacgcgccttctccgctcccaagtgaaccaaggggttgcgcagaagctttcaggtaattgaacctatttgggaaaaaaaaaaaggggggaaaaaaaaaaaaaaaggggggggnttttttctaaaaaaaggggggggggggggggggggggggttttgggtggttttttttttttttttatnnaaaaaaaaaaaaaaaaaaaaaaagggatggtttgtnttcccggggggggagggaaagaagag

SEQ ID NO: 36036 - protein, 93 aa, Zea mays
  misc_feature: Ceres CLONE 1418788-F
  misc_feature (82)..(82): Xaa is any aa, unknown, or other
MASPAGANSGASSSRGTPLPLPFPFPAAAHFPSRGAGPFLSQHYHPPSTSDGDDEVEEDEGSMDDGSAEEDDAELSDGGALXSPRRRAFSAPK

SEQ ID NO: 36037 - DNA, 743 bp, Zea mays
  misc_feature: Ceres CLONE 1418789-F
  misc_feature (33)..(33): n is a, c, t, g, unknown, or other
gggggcggcgcccccccccccgaggggccggcntggggggggggagttggttgtccagagctggagctccccgcggtggcggccgctctagaactagtggacccccgggctgcaggattcgcacgagaccattacctagaacatcctaatcgaaaaacatattattgagaccaactagcaacatagaaagcacaatagtgtaccaacaatgggagggcaaaaatattttgggccttccttaggccctgggtctttctggaagggctggatgggggggacatgttcgcgggaggggtccggaagtttgtgagaggggtttcatattttcccgggaatttgtaaaaaggggtgggtccgggttggaaaaacgccatatttgggcgccgcgcagaagggggcaaggggggaagcgtggggggggggggggtggacactcttgtgtaaaaggcttgtgatgtggggggggcgtctgcgcgtggcctggggggtaggtattcgggcggggcgggccctcttgttaataattctgggggtggaccaccactagcagcgggtcattgagtgtctgccacggaaaaacgaacccagcgcaagggtgtacaccggcaacgtaagtatggtgggtgggggtgttaaaaagggaggggggaaatggggaggggcccggggcggttgaaaggaaaacaagaaggttagatttacaattagtgccggtgaaccccggtgcgatccgtgggtctctc

SEQ ID NO: 36038 - DNA, 629 bp, Zea mays
  misc_feature: Ceres CLONE 1418795-F
  misc_feature: Encodes the peptide sequence at SEQ ID NO. 36039
ccgcggtggcggccgctctagaactagtggatcccccgggctgcaggaattcgcacgagaccattacctagaacatcctaatcgaaaaactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatctcagcccgtgctggtgccggcgccatcgcgctgcgctcatggcggcgggttcgtcacctccggcggctcggcgtcgctgcgctgtccgtgttctcctggatgtacaagtacctgacgggcaaagcacccgccgggcggcgaccagctgtgaccacgccaaggcgaggcctggcgtcccagggcccgccgacatctaaggatggagcccaggcccccgcatcgaaccaggg

SEQ ID NO: 36039 - protein, 153 aa, Zea mays
  misc_feature: Ceres CLONE 1418795-F
  misc_feature (36)..(148): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVISARAGAGAIALRSWRRVRHLRRLGVAALSVFSWMYKYLTGKAPAGRRPAVTTPRRGLASQGPPTSKDGAQAPASNQ

SEQ ID NO: 36040 - DNA, 678 bp, Zea mays
  misc_feature: Ceres CLONE 1418796-F
  misc_feature: Encodes the peptide sequence at SEQ ID NO. 36041
aagctggagctccccgcggtggcggccgctctagaactagtggatcccccgggctgcaggaattcgcacgagaccattacctagaacatcctaatcgaaaaaaaaaaaaaaaaaaaaggcggagaagccaacgataccatccttgctcaaaaattcaaactccgataacctctcacgcgcctccctacgcgcaacgatcccaaattttcaaacgatggagccggcgaaggtagattccgatgcgaagactgtcaaggatccgaatccgagcgccgatccgaaagccgcggatcaaggaccggcgaagaaggtaggcgaggacgcgaacgccgagatcgccttgtcggaggtcgaaatcgagacgaaagggatcgatccagcagcggcgcaggcggaagcgcagccgccggcgaggacgtcgtctggatcgaagaaatcggtgcactggagccccgagctggtgtccgggtctcaggagccggatcagaagtccgcttcgtcgtacccggcgggatctaatccgtatattgctcgttctccggctgagacgtcggatgcttccttgaaagatacgatggagtctgtgaaaggagcgcttgggagatgggggaaggagggttgctgaagctgctaagaagacggagagccttgccggcaacacgtggcagcacctgagaa

SEQ ID NO: 36041 - protein, 136 aa, Zea mays
  misc_feature: Ceres CLONE 1418796-F
MEPAKVDSDAKTVKDPNPSADPKAADQGPAKKVGEDANAEIALSEVEIETKGIDPAAAQAEAQPPARTSSGSKKSVHWSPELVSGSQEPDQKSASSYPAGSNPYIARSPAETSDASLKDTMESVKGALGRWGKEGC

SEQ ID NO: 36042 - DNA, 664 bp, Zea mays
  misc_feature: Ceres CLONE 1418797-F
  misc_feature: Encodes the peptide sequence at SEQ ID NO. 36043
aagctggagctccccgcggtggcggccgctctagtactagtggatcccccgggctgcaggaattcgcacgagaccatacctagaacatcctaatcgaaaaaacgcccccatccgtttcttcctccttgccaggacaggagtctcaactctcaagtctcaaccacgtggagagtggagtagtggaccgaccatggccaccgccgccgacatccgcgtctccatcggctaccagacccgcttcgggctccgcctcgccgccgcgctctcctccccacccccatcccccgccagcaactccgccttctccccgctctccctccacgtcgcgctcagcctcctcgccgccggcgcgggtggcgccacgcgcgaccagctcgccgccgccctcggaggcgacgcgcccgccggggccgacggcctgcacgcgctcgccgagcaggtcgtgcagctcgtgctcgccgacggctccgggcgcggcggcccgcgcgtcgccttcgccgaccgcgtcttcgtcgactccctcctgaagctcaagccggcctttcgagaggtcgccgttgggaaagtacaggggccaaaccccagtcccgtcgactttccagaaaaaggcttcctgaaacctgctggtcaaagtgaacttcatggggtagaaaaaaattacctt

SEQ ID NO: 36043 - protein, 158 aa, Zea mays
  misc_feature: Ceres CLONE 1418797-F
MATAADIRVSIGYQTRFGLRLAAALSSPPPSPASNSAFSPLSLHVALSLLAAGAGGATRDQLAAALGGDAPAGADGLHALAEQVVQLVLADGSGRGGPRVAFADRVFVDSLLKLKPAFREVAVGKVQGPNPSPVDFPEKGFLKPAGQSELHGVEKNYL

SEQ ID NO: 36044 - DNA, 690 bp, Zea mays
  misc_feature: Ceres CLONE 1418801-F
  misc_feature: Encodes the peptide sequence at SEQ ID NO. 36045
atagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacataccttttatcacccttggttcaaccattcgccagcccctatcttttggtgccagccattggtaccaaaccatccaggggacaagcagcctgcaagcaacttcgtggcaccctgttgaccaccccaggagcctctgggcaaacctttttccccctaatcccccccaaacaacaattttctttcccttccaacccaattggtctacatttgaaacccggggccttctttattttggaaagcaacaaattattaccttttttgagccctggttaaccttatccgccccatttctcaggctacccacaacatttctttccattt

SEQ ID NO: 36045 - protein, 173 aa, Zea mays
  misc_feature: Ceres CLONE 1418801-F
MATKIFSLLMLLALSACVANATIFPQCSQAPIASLLPPYLPSMIASVCENPALQPYRLQQAIAASNIPFITLGSTIRQPLSFGASHWYQTIQGTSSLQATSWHPVDHPRSLWANLFPPNPPQTTIFFPFQPNWSTFETRGLLYFGKQQIITFFEPWLTLSAPFLRLPTTFLSI

SEQ ID NO: 36046 - DNA, 660 bp, Zea mays
  misc_feature: Ceres CLONE 1418804-F
  misc_feature: Encodes the peptide sequence at SEQ ID NO. 36047
aaagctggagctccccgcggtggcggccgctctagaactagtggatcccccgggctgcaggaattcgcacgagaccattacctagaacatcctaatcgaaaactttctcgagcctgacccttacgccttcgctcgcgccgccgccgccgacgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactggctgttttgccgagacaatgctccttatatttggtttatgctctaggatctcaaagttgtgttgttgagatttgccctcggttaccgttctgaat

SEQ ID NO: 36047 - protein, 92 aa, Zea mays; identical to SEQ ID NO: 7812
  misc_feature: Ceres CLONE 1418804-F
  misc_feature (2)..(91): Pfam Name: Ribosomal_L37ae Pfam Description: Ribosomal L37ae protein family

SEQ ID NO: 36048 - DNA, 655 bp, Zea mays
  misc_feature: Ceres CLONE 1418819-F
  misc_feature: Encodes the peptide sequence at SEQ ID NO. 36049
ggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccggccagctctttccaccctgagcaagctcaattcatgggggaaaggagggaattcccccccaaaaaaactttttgcccccgggggcccccacccaccaccttgttttaaaaaaaaaaaatattttttcacaacacctttctccttgtgtggggcccccacaaagaaaagagagttgtcccgccccccaaccc

SEQ ID NO: 36049 - protein, 147 aa, Zea mays
  misc_feature: Ceres CLONE 1418819-F
MRECISIHIGQAGIQVGNACWELYCLEHGIQADGQMPGDKTIGGGDDAFNTFFSETGAGKHVPRAVFVDLEPTVIDEVRTGTYRPALSTLSKLNSWGKGGNSPPKKLFAPGGPHPPPCFKKKKYFFTTPFSLCGAPTKKRELSRPPT

SEQ ID NO: 36050 - DNA, 718 bp, Zea mays
  misc_feature: Ceres CLONE 1418822-F
  misc_feature: Encodes the peptide sequence at SEQ ID NO. 36051
  misc_feature (431)..(431): n is a, c, t, g, unknown, or other
aaactggagctccccgcggtggcggccgctctagaactagtggatcccccgggctgcaggaattcgcacgagaccattacctagaacatcctaatcgaaaaccccgccctccgaagtccgaaggccagaagcttccggaagccagcccaagccatgaacgccgccagcaccgccgccgcggcccccgcgcctgccgcgaccgtgcaggtcccgcgcgggcaggtggatctgatcgacttcatcgactggaccggcgtcgagtgcctcaaccaggactcgtcccacagcatcgtcaacgcgctcaagcagagtttgagagacgacgaggggctgtacctcgccagcgattcggacgagcagctgctgatctacatccccttcatgcaggtagtcaaactgcattccgcgctattcaaaggtccccgaagaangagggcccccaaaaacagtaaaacttcttcctcaaaccaaagagcattatgggttttcaagcaatggtcatggacctatccccccaaggtgacaccccttcgaagcttttcttcccgaatcattttgaaaaaaaaaataaacctttgtgccccctaaagggtagtgccaggttttcaaaaaagggtccccggtctggccttttttttttgggggacacaccaagggggaaggggattgcctcccaaatttcccaaaatttggctcttttatggaaaaaacttgggga

SEQ ID NO: 36051 - protein, 144 aa, Zea mays
  misc_feature: Ceres CLONE 1418822-F
  misc_feature (93)..(93): Xaa is any aa, unknown, or other
MNAASTAAAAPAPAATVQVPRGQVDLIDFIDWTGVECLNQDSSHSIVNALKQSLRDDEGLYLASDSDEQLLIYIPFMQVVKLHSALFKGPRRXRAPKNSKTSSSNQRALWVFKQWSWTYPPKVTPLRSFSSRIILKKKINLCAP

SEQ ID NO: 36052 - DNA, 709 bp, Zea mays
  misc_feature: Ceres CLONE 1418825-F
  misc_feature: Encodes the peptide sequence at SEQ ID NO. 36053
ccccgcggtggcggccgctctagatccgtggatcccccgggctgcaggaattctcaccagacaattacctagaacatcctaatcgaaaactcttttccgccctccacccctcgcgagctctccacccctccacacgaccctcctcggcggcggcggcggcgatgcagatggcggcgaccaccaccgagtcccaggcggccgtgccgcctcaacaccctcacgcccacccccacgcgcccccgcagcatgctcacccgcaccaccacatgccgcagccacggtgggtcgtcatcccgtacccgccgccgccgcccatggtggccgcgccaccaccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaatagggaaacaggacagtcagaggggtatggatttgttgagttcttttctcatgcatcagcggagggggctcctgcggaattttactgggtcatgtgatgccaaacacttgaccgggcttttaaaatgaactggggcatcctatggggtgg

SEQ ID NO: 36053 - protein, 113 aa, Zea mays
  misc_feature: Ceres CLONE 1418825-F
  misc_feature (50)..(112): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MVAAPPPPPQFAKHFAAGPPPPPQAGAGRRTPTPPSSGSGGNGCEENKTIWVGDLQYWMDENYLHNCFGPSGEVVTIKVIRNRETGQSEGYGFVEFFSHASAEGAPAEFYWVM

SEQ ID NO: 36054 - DNA, 647 bp, Zea mays
  misc_feature: Ceres CLONE 1418832-F
  misc_feature: Encodes the peptide sequence at SEQ ID NO. 36055
ctccccgcggtggcggccgctctagaactagtggatcccccgggctgcaggaattcgcacgagaccattacctagaacatcctaatcgaaaaatccgggagcggctagctgttcgttccccctccaatgccggccacccatcaccttcccctccgcgcgcgcccgtgccctcaccaccacatctaatcggctaatcagccttcggtcttccccttgcgtttctccgcgcgcccgacctccttcgctgccccatggacgctaccccgccgtcgtcgcgggacctgtcgccgcagccccggcggccggcctcctccgcggagcccgccaagcgcgtgggccttctgctcggccgctacgagctgggccgcctgctcggccacagcaccttcgccaaagtctaccacgcccgcccaagccgacaccggggagaccgtcgccatcaaggtgctcgataaggagaaggccctccggaaacggcctcctccccaaattaaggggcaaaaacgccatcctcccgcccgggggggccacccccaaaatcgttccgcccctttcaaaggccatggcccccccaagtccaaaaattccccttcccccaagggaatttctctcccgccggggggggaagattttttccggggggggtt

SEQ ID NO: 36055 - protein, 28 aa, Zea mays
  misc_feature: Ceres CLONE 1418832-F
MAPPSPKIPLPPREFLSRRGGKIFSGGG

SEQ ID NO: 36056 - DNA, 657 bp, Zea mays
  misc_feature: Ceres CLONE 1418837-F
  misc_feature: Encodes the peptide sequence at SEQ ID NO. 36057
aagctggagctccccgcggtggcggccgctctagaactagtggatcccccgggctgcaggaattcgcacgagaccattacctagaacatcctaatcgaaaaagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcatttgatccgtcccggccgcctacacgatgtccaagtcgggagcgctggatcttgcttctggcctcggagggaagatcaacaatgtggaagtcaagtctgccgtctatgagtatgagagatatcatgcatactatggaggggaaggaggcagcaatgaagtccaactatactggatatgggttataaatactatggatcttgccacctagcttctatgagtttgggtgggggtggaatcctttcactttgcctcccgaatgggatggaagaatcctttccctgaaaggcatcataccgacattgacctttttctttggccttgcaactgggtttgaaacaccgggaaatgaagggttttaaaatgtgggctgtggaaaataaggggggcccc

SEQ ID NO: 36057 - protein, 60 aa, Zea mays
  misc_feature: Ceres CLONE 1418837-F
  misc_feature: SWISSPROT Homolog: EC 2.1.1.41 Sterol 24-C-methyltransferase
MSKSGALDLASGLGGKINNVEVKSAVYEYERYHAYYGGEGGSNEVQLYWIWVINTMDLAT

SEQ ID NO: 36058 - DNA, 714 bp, Zea mays
  misc_feature: Ceres CLONE 1418844-F
  misc_feature: Encodes the peptide sequence at SEQ ID NO. 36059
  misc_feature (640)..(640): n is a, c, t, g, unknown, or other
tccccgcggtggcggccgctctagaactagtggatcccccgggctgcaggaattcgcacgagaccattacctagaacatcctaatcgaaaagaggcctcccgtcgcggtggtcgctttcggccctggaccccgctgccggaatcgaatctcctcccctcctttctcctccgacctcccccttcaccccctccgcggctccgccccgacccgtgacgcctcgcttcgcacccctctcgcatctccgccgcatctccgccgcgatcctcccgactagccgcgactgcctcccctccagcggccaggcagaggatggagggggcaggcaaggatggcaacccgttgaggaattatcggattggcaagactctcggaattggctcattcgggaaggtgaaaattacggagcatatcagcactggacacaaggtggcaatcaagattctcaaccgccgtaaaatcagaggcatggagatggaagagaaagttaaaagagagattaagatattgaggttatttatgcatccacatattatccgcctctatgaggttatagacacaccggctgatatttatgttgttatggagtatgttaagtgtggggaattatttgattacattgttgagaaaggtaggctgcangaagaaagagctcgccgtttctccaacaagatatatccgggtgtgaaatatgccatagaaacatggtggtgcat

SEQ ID NO: 36059 - protein, 134 aa, Zea mays
  misc_feature: Ceres CLONE 1418844-F
  misc_feature (14)..(133): Pfam Name: Pkinase Pfam Description: Protein kinase domain
  misc_feature: SWISSPROT Homolog: EC 2.7.11.1 Non-specific serine/threonine protein kinase
  misc_feature (110)..(110): Xaa is any aa, unknown, or other
MEGAGKDGNPLRNYRIGKTLGIGSFGKVKITEHISTGHKVAIKILNRRKIRGMEMEEKVKREIKILRLFMHPHIIRLYEVIDTPADIYVVMEYVKCGELFDYIVEKGRLXEERARRFSNKIYPGVKYAIETWWC

SEQ ID NO: 36060 - DNA, 702 bp, Zea mays
  misc_feature: Ceres CLONE 1418846-F
  misc_feature: Encodes the peptide sequence at SEQ ID NO. 36061
  misc_feature (641)..(641): n is a, c, t, g, unknown, or other
  misc_feature (688)..(688): n is a, c, t, g, unknown, or other
ctccccgcggtggcggccgctctagaactagtggatcccccgggctgcaggaattcgcacgagaccattacctagaacatcctaatcgaaaaaaccgcagcagggcgttgggcgagtgagtgagtcagtgaggctgggatagcagcagcagcatcagtgcgccgcactcaacttctcttcttgccgtgcggtgcggcgcggcgcggggaggcaccgcacggccgcaagcaatgccgcgccggcagaggacgcgcagcagcgaggagctcaaggcggaggacttcgtcgactcggtgctcaacttcggcggcgaggaggaggatggggaagaggagaagcaggaggccggcggggacggccagccggcggcggagttcaagtccaagaacctggaggccgagcggaagcggcgcggcaagctcaaccgcaacatcctcgcgctcagggccgtggtgccgaacatcaccaagatgagcaaggagtccaccctctcggacgctatcgacctcatcaagaagctccagaaccaggtccttgagctgcagcgccagctcgccgactcgcccggagaggcctgggagaagcagggcagcgcgtcgtgctctgaatccttcactgccacggaaaacatgccgtatcanggtcagatcgagctggttcctctggggccatgcaagtaccacctcangatcttctgcaaga

SEQ ID NO: 36061 - protein, 157 aa, Zea mays
  misc_feature: Ceres CLONE 1418846-F
  misc_feature (51)..(98): Pfam Name: HLH Pfam Description: Helix-loop-helix DNA-binding domain
  misc_feature (137)..(137): Xaa is any aa, unknown, or other
  misc_feature (153)..(153): Xaa is any aa, unknown, or other
MPRRQRTRSSEELKAEDFVDSVLNFGGEEEDGEEEKQEAGGDGQPAAEFKSKNLEAERKRRGKLNRNILALRAVVPNITKMSKESTLSDAIDLIKKLQNQVLELQRQLADSPGEAWEKQGSASCSESFTATENMPYXGQIELVPLGPCKYHLXIFCK

SEQ ID NO: 36062 - DNA, 647 bp, Zea mays
  misc_feature: Ceres CLONE 1418850-F
  misc_feature: Encodes the peptide sequence at SEQ ID NO. 36063
tccccgcggtggcggccgctctagaactagtggatcccccgggctgcaggaattcgcacgagaccattacctagaacatcataatcgaaaatttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcgtcggcgcggggcgcctcgccgacgccgcctcctccggccgcgcgtcccccgccggcgcagcttttcaacaggccgggcgcccaccagccgcagctcttcccgcccggtccgggcgcgttccaccacccgtcggcgcgggcgatgcccgccattgttcccaggcggcggcaaggacgagggccacatgttccacattccaccggcacaccatggcagcaagccactgcacatgaacgagctccagcaccggcaccagcagacgatgggggcccggtgggcaggcgccccacggtgaacttccggtgggcccacgggctggcccttcttcaccggggcttcacgggcgaaaacaacgacgcgaa

SEQ ID NO: 36063 - protein, 141 aa, Zea mays
  misc_feature: Ceres CLONE 1418850-F
MRHTFESLGYQSGFFLSQLFSSARGASPTPPPPAARPPPAQLFNRPGAHQPQLFPPGPGAFHHPSARAMPAIVPRRRQGRGPHVPHSTGTPWQQATAHERAPAPAPADDGGPVGRRPTVNFRWAHGLALLHRGFTGENNDA

SEQ ID NO: 36064 - DNA, 664 bp, Zea mays
  misc_feature: Ceres CLONE 1418851-F
  misc_feature: Encodes the peptide sequence at SEQ ID NO. 36065
  misc_feature (371)..(371): n is a, c, t, g, unknown, or other
  misc_feature (422)..(422): n is a, c, t, g, unknown, or other
  misc_feature (426)..(426): n is a, c, t, g, unknown, or other
ctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgacttcggcgggtcgatgctggtgctgtccgggctgatcctggncggcaccgtgatcgcgctcacggtggccacccccgtgctggtgatcttcancccngtgcctgtgccggccggcatcgcgctggcgctcatgcggccggggtcgtcacctccgcggcctcgggggtcctgccctgtcggtgttccctggaatgacaagtacctgacgggaagcccccgccggggccaaccaattggaccccccaaggggaggctggggtccaaaggccccgaaattaaggatgggggcacaagccccctttcaacaaggggaagggggttttaaaaaaaaaaac

SEQ ID NO: 36065 - protein, 103 aa, Zea mays
  misc_feature: Ceres CLONE 1418851-F
  misc_feature (1)..(92): Pfam Name: Oleosin Pfam Description: Oleosin
  misc_feature (10)..(10): Xaa is any aa, unknown, or other
  misc_feature (27)..(27): Xaa is any aa, unknown, or other
MLVLSGLILXGTVIALTVATPVLVIFXPVPVPAGIALALMRPGSSPPRPRGSCPVGVPWNDKYLTGSPRRGQPIGPPKGRLGSKGPEIKDGGTSPLSTRGRGF

SEQ ID NO: 36066 - DNA, 676 bp, Zea mays
  misc_feature: Ceres CLONE 1418860-F
  misc_feature: Encodes the peptide sequence at SEQ ID NO. 36067
  misc_feature (676)..(676): n is a, c, t, g, unknown, or other
agctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacccggtagtagctgttgcccaagttgagttgcaaacaatgaacgtggcagcagcccgctgatgttgccggacccaggcgagggggtggcgggcgatcctccaaaggggggaagggtagggcccgaacccggtgcagtcgcctgcagggaagaaggtttgggactttacggggattcaacctgcccggtggggggaaacctttggactggcggcccctcccacccgtttaactcccacaaaagcan

SEQ ID NO: 36067 - protein, 92 aa, Zea mays
  misc_feature: Ceres CLONE 1418860-F
  misc_feature (14)..(38): Pfam Name: zf-A20 Pfam Description: A20-like zinc finger
MEHKEAGCQAPEGPILCINNCGFFGSAATMNMCSKCHKEMITKQDQAKLAASSIDSIVNGSDAVMEPVVAGSNPVVAVAQVELQTMNVAAAR

SEQ ID NO: 36068 - DNA, 712 bp, Zea mays
  misc_feature: Ceres CLONE 1418863-F
  misc_feature: Translation starting site: 206
  misc_feature (171)..(171): n is a, c, t, g, unknown, or other
  misc_feature (447)..(447): n is a, c, t, g, unknown, or other
  misc_feature (459)..(459): n is a, c, t, g, unknown, or other
  misc_feature (460)..(460): n is a, c, t, g, unknown, or other
  misc_feature (511)..(511): n is a, c, t, g, unknown, or other
  misc_feature (512)..(512): n is a, c, t, g, unknown, or other
aaagctggagctccccgcggtggcggccgctctagaactagtggatcccccgggctgcaggaattcgcacgagaccatacctagaacatcctaatcgaaaaaactactccgtcactttgtttacaaagctcctcctcgatccatcgatcactgcaccggccggcggcaccngcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggcacgccngtgtcctgatcnntcagcccgtgctcgtccccgccgcgctgctcatcgggaacgccgtcatggnngtcctcacgtcgggcgcgctggggctcgggggcctgtcctcgctcacgtgcctcgccaacagggggcggaaggggtcccagcgcaccccggactacgtgaaggaagccacccccaggagggcggaggcccccgcccaaccgggccaaaaaaccgccaagggagccaggcccttcaagggagggcccaagaggcccgcccc

SEQ ID NO: 36069 - DNA, 681 bp, Zea mays
  misc_feature: Ceres CLONE 1418866-F
  misc_feature: Encodes the peptide sequence at SEQ ID NO. 36070
aaagctggagctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggacggtatccagagtcggaaacgcgtgctgggagctgtactgacttgagcatggcattcaggctgacggtcagatgcccggtgacaagaccattgggggaggtgatgatgctttcaacaccttcatcaatgagactggtgctgggaagcacgtgccccgtgctgtttttgttgaccttgaacccactgtcatcgatgaggtgagaactggcacctacagccagctcttacaccctgagcagctcatcagtgggaaggaggatgcagccgacaactatgcccgtggtcactacaccattggcaaggagattgctgacctgtgccttgatcgcatcaggaagcttgccgacaactgcactggttctcagggcttcctcatcttcaacgctggttggtggaggaacgggctctgggccttggttccctcctcc

SEQ ID NO: 36070 - protein, 119 aa, Zea mays
  misc_feature: Ceres CLONE 1418866-F
  misc_feature (14)..(119): Pfam Name: Tubulin Pfam Description: Tubulin/FtsZ family, GTPase domain
MPGDKTIGGGDDAFNTFINETGAGKHVPRAVFVDLEPTVIDEVRTGTYSQLLHPEQLISGKEDAADNYARGHYTIGKEIADLCLDRIRKLADNCTGSQGFLIFNAGWWRNGLWALVPSS

SEQ ID NO: 36071 - DNA, 753 bp, Zea mays
  misc_feature: Ceres CLONE 1418870-F
  misc_feature: Encodes the peptide sequence at SEQ ID NO. 36072
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (43)..(43): n is a, c, t, g, unknown, or other
  misc_feature (44)..(44): n is a, c, t, g, unknown, or other
nnnnnnnnnnnnnnnnnnnnaacggacaaannnnnnannnggnntttaaggttttcatagctgggactccccgcggtggcggccgctctagaactagtggatcccccgggctgcaggaattcgcacgagaccattacctagaacatcctaatcgaaaaacccatccgccgcttcgtcccaaatcccttttggcgggagacgagcagcaggctgcctccacttcccgcgcaaagcagtaaatcggagtaaccatggacggcggatcctccacaccggcgagccccccaccgacggtatccgcgtcggcggagaatatggaggagtaccggaactggaagaagaacgcggcggtgctttacgacctcgtcatctcccacccgctcgagtggccatcgctcaccgtgcagtggctcccatcggagtcctcggcccgcagccaccggcttcgcgtgggtactcacacctccgacgaggcccccaacaacctcatggtcttggacgcggagctaccgctcccacctcgcctcgctgcagccggccctgcctcgggcggcgccgtcccgttcccattccgaatccggtcccgcggcggtggcgccacaccgagggctgagggcaaaccgcggcgggcgctggcttgcccgcaggcgtcccctaggacggggggggcccccccaaaaaccgttgccgtccgaaccaatgggtgccaccgttggtaaccccatccttccggcggaaatttaaccgaccggg

SEQ ID NO: 36072 - protein, 155 aa, Zea mays
  misc_feature: Ceres CLONE 1418870-F
  misc_feature: SWISSPROT Homolog: EC 2.3.1.48 Histone acetyltransferase
MDGGSSTPASPPPTVSASAENMEEYRNWKKNAAVLYDLVISHPLEWPSLTVQWLPSESSARSHRLRVGTHTSDEAPNNLMVLDAELPLPPRLAAAGPASGGAVPFPFRIRSRGGGATPRAEGKPRRALACPQASPRTGGAPPKTVAVRTNGCHRW

SEQ ID NO: 36073 - DNA, 689 bp, Zea mays
  misc_feature: Ceres CLONE 1418871-F
  misc_feature: Encodes the peptide sequence at SEQ ID NO. 36074
  misc_feature (51)..(51): n is a, c, t, g, unknown, or other
  misc_feature (490)..(490): n is a, c, t, g, unknown, or other
aagctggagctccccgcggtggcggccgctctagaactagtggatcccccngggctgcaggaattcgcacgagaccattacctagaacatcctaatcgaaaaacctttctttccctcttccgtcttccccaacccaaccacccgcaccaagccgacccagagagaggagagcctgcttgcctgcctgggctggactcccccttcgcctcctcctcgtccgatcggccccgccccgcctagctgctgctgctgctgctgctgctgctgcgcgcgcgccgcggcgggacccgggaggagcgccggtggtggtggccgggcccgatggagtgggcgtcggcggcgtacacggctgcggcgctggtgtgcgccgcggcggcgagcgtggtcgcgctcgcgcacatctaccgccacctccctcactacggcgagcccatctaccagcggttcatcgtccgcatcatattcatggccccggaataagctgggatgncattccttttccctaatctccctgacaaccgaaaaatttttaattctattcaagaaaaatgagagcgtgggtcaacctacaattttccccaccccgcttggcatgggggggaagcccctgggcttgggggggaaacatttgaagggcccaaccccgaaaccccccggaataccaaaacattgctgtttaccccctttcc

SEQ ID NO: 36074 - protein, 52 aa, Zea mays
  misc_feature: Ceres CLONE 1418871-F
MEWASAAYTAAALVCAAAASVVALAHIYRHLPHYGEPIYQRFIVRIIFMAPE

SEQ ID NO: 36075 - DNA, 616 bp, Zea mays
  misc_feature: Ceres CLONE 1418895-F
  misc_feature: Encodes the peptide sequence at SEQ ID NO. 36076
  misc_feature (164)..(164): n is a, c, t, g, unknown, or other
aaaactggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttngactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccattccaacatgcaggcgcaacttgatctgttccccagagtcttcggccacgaggcatcccgagtagtagagagtgtcgggtgaaggtgtgaccgattccaagtcggtgaccactttctactgtcttcatggggaagcaaaac

SEQ ID NO: 36076 - protein, 66 aa, Zea mays; identical to SEQ ID NO: 22274
  misc_feature: Ceres CLONE 1418895-F
  misc_feature: SWISSPROT Homolog: EC 1.1.1.1 Alcohol dehydrogenase

SEQ ID NO: 36077 - DNA, 677 bp, Zea mays
  misc_feature: Ceres CLONE 1418915-F
  misc_feature: Encodes the peptide sequence at SEQ ID NO. 36078
aaagctggagctccccgcggtggcggccgctctagaactagtggatcccccgggctgcaggaattcgcacgagaccattacctagaacatcctaatcgaaaaaaaaaccgcaccgcaccgcaacgcgccaccgatccaccccgcgtcctcggcctccctccctccggcgagcggcggcgcgggcggccatggaggtgttctactacgtcgtgttcggcgcgctggccgccatcgtggcggggctcgagctcggcaagagcggcaaggaccgcgtcgccactacctccgcctttaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctccatgctcttcggcaccatcgtcggctccctcgccgacaaacaaggccgcaagagggcctgcatcacctactgcatcagctacatcctcagctgcatcaccaagcactcccccgagtacagggtcctcatgatcggccgcatcctcggaggcatcgccacctcgctgctcttctccgccttcgagtcctggctcgtcgcagagcacaacaagagaagctttgacccgcagtggctg

SEQ ID NO: 36078 - protein, 163 aa, Zea mays
  misc_feature: Ceres CLONE 1418915-F
  misc_feature (4)..(163): Pfam Name: DUF791 Pfam Description: Protein of unknown function (DUF791)
MEVFYYVVFGALAAIVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAEHNKRSFDPQWL

SEQ ID NO: 36079 - DNA, 656 bp, Zea mays
  misc_feature: Ceres CLONE 1418926-F
  misc_feature: Encodes the peptide sequence at SEQ ID NO. 36080
aagctggagctccccgcggtggcggccgctctagaactagtggatcccccgggctgcaggaattcgcacgagaccattacctagaacatcctaatcgaaaactcctcgcggctcatagaaacctcaaaacccaaccaggacagcgtccacagaaagaagagagagcacatagagtggagtggtggacagaccatggagctctgcgtctctacacccccatcctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtcacggacaagcccgatacgcctgccgacgacaaggccgaggaggttagcgccgcgcctagtggctccgcggaggcgcctatggcagagctggtgccgtcagaggcgtcatcatccccagatgatggcggcctggatgagatttctagcaaggttggaaaaaaatggaggctattctcttatcattatgtccttgccaaaacaaatattgggactcttgccagattgactaccatgatccccttgtgtttacctag

SEQ ID NO: 36080 - protein, 154 aa, Zea mays
  misc_feature: Ceres CLONE 1418926-F
  misc_feature: SWISSPROT Homolog: EC 3.1.3.48 Protein-tyrosine-phosphatase
MELCVSTPPSSVRATAAPISFAPPRRGASASTAVPPHRRIPTRGWRCASAAVPGPVPSEEPASASYAVVVTDKPDTPADDKAEEVSAAPSGSAEAPMAELVPSEASSSPDDGGLDEISSKVGKKWRLFSYHYVLAKTNIGTLARLTTMIPLCLP

SEQ ID NO: 36081 - DNA, 704 bp, Zea mays
  misc_feature: Ceres CLONE 1418930-F
  misc_feature: Encodes the peptide sequence at SEQ ID NO. 36082
  misc_feature (704)..(704): n is a, c, t, g, unknown, or other
aagctggagctccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagctgatggctacatcagagccagtacaagagagtttggtggtgcactactcacaacctagtaggccccgggtcctccttgctgcttcaggaagtgtagccgctataaaatttgagagcctttgccgtagcttctctgagtgggcggatgtccgagctgtggccaccacgtcatccttgcacttcgttgatagatcatctctaccaagtggcatcgttctttacactgatgatgatgaatggtcaacctggaagaagaatagagatgaagtcttacacatcgagctgcgn

SEQ ID NO: 36082 - protein, 95 aa, Zea mays
  misc_feature: Ceres CLONE 1418930-F
  misc_feature: SWISSPROT Homolog: EC 4.1.1.36 Phosphopantothenoylcysteine decarboxylase
MATSEPVQESLVVHYSQPSRPRVLLAASGSVAAIKFESLCRSFSEWADVRAVATTSSLHFVDRSSLPSGIVLYTDDDEWSTWKKNRDEVLHIELR

SEQ ID NO: 36083 - DNA, 825 bp, Zea mays
  misc_feature: Ceres CLONE 1418933-F
  misc_feature: Encodes the peptide sequence at SEQ ID NO. 36084
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ggggggcccccnnnccccnccnccccccnnnggnnnntttttttnnnnnnnccaagctggagctccaccgcggtggcggccgctctagaactagtggatcccccgggctgcaggaattcgcacgagaccattacctagaacatcctaatcgaaaaactatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacttccagcgcgggggcggcatgcacggcgaggcgcagcaccagcagaagcaaggcgccatgatgacggcgctcaaggccgcgacgggccgccaaccttccggcggggtcggatgctggggggcttgtccgggggctggaattcctggggccggggccccggggatcgcggcctccccggggggccaccccccccggggcttgggggaatctttaaaacccccggatgcctcgggggcccggggcccccaccattccgggctgggggcgactcaagggggggggcgggggggttttggttaacttttcgggggcggggcactcgcggggggggagcagggcgagtgggcgcggcggggccccccccggggggggtgcccaagtggcccctggaaggggtgcaaaacacccccccgcgggggggggcccgaaacacgggtgggcacccaccccccaaaggcgagacggctgggggcgtccacaaaggccgcccggcgcaacttctgggggtgccgcgccccccgcccc

SEQ ID NO: 36084 - protein, 116 aa, Zea mays
  misc_feature: Ceres CLONE 1418933-F
MADHHRGATGGGGGYGDFQRGGGMHGEAQHQQKQGAMMTALKAATGRQPSGGVGCWGACPGAGIPGAGAPGIAASPGGHPPRGLGESLKPPDASGARGPHHSGLGATQGGGRGGFG

SEQ ID NO: 36085 - DNA, 451 bp, Zea mays
  misc_feature: Ceres CLONE 1418936-F
aagctggagctccccgcggtggcggccgctctagaactagtggatcccccgggctgcaggaattcgcacgagaccattacctagaacatcctaatcgaaaagagtttcctattttcctctcctcccccacagcagctcggcgaaaaccctagtaagcaaaccaccggagcagcggcgcttgcgcgagcggagccatggcggacgacgattacaacgaaattgacatggggtatggagatgagcccccagacccgagattgagggaggagctgaagaagagcctgaaaccatgaaaaatgcccctgatgactcctaggtgggaggggaaataaggaaccggaaaaaccccgggtggaccccaaacaccaaaattcttggccaaaattcaaaggggcccccaccccgggggaaacaaacccctttgaaaaaaaaaacgtgaaagggccccccc

SEQ ID NO: 36086 - DNA, 711 bp, Zea mays
  misc_feature: Ceres CLONE 1418944-F
  misc_feature: Translation starting site: 172
  misc_feature: SWISSPROT Homolog: EC 6.1.1.16 Cysteine--tRNA ligase
  misc_feature (531)..(531): n is a, c, t, g, unknown, or other
  misc_feature (637)..(637): n is a, c, t, g, unknown, or other
  misc_feature (649)..(649): n is a, c, t, g, unknown, or other
  misc_feature (711)..(711): n is a, c, t, g, unknown, or other
tggagctccccgcggtggcggccgctctagaactagtggatcccccgggctgcaggaattcgcacgagaccattacctagaacatcctaatagaaaactttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcactcgcagctacatcactggctaccaagcttccaaggatgacttggctgtctacacttcgttttcggctgctccctcgtccaagtatatcaacgtagcaaggtggtttaaccacattgatgcgctcgtgaggctgagcggaattactgcagagggccaaggtgtgaaggttgaatcctcagcagttccttcagccccaactccagatgttgctgaagcacaggccccagttgctgaggaggacgacgacgatgatgttgacctttttggtgaggagaccgaagatgagaagaangctgctgaagagcgtgctgcagctgccaagggcttctggcagaagaaagatctggggagtcatcagttttacttgatgtgaagccatgggacgatgagactgacantgccaagctcgnagaaagctgtaagaatgtccagatgggagggctgctctggggcgcatccaagcttgtcccan

SEQ ID NO: 36087 - DNA, 677 bp, Zea mays
  misc_feature: Ceres CLONE 1418947-F
atagctggagctcaccgcggtggcggccgctctagactagtggatcccccgggctgcaggaattcgcacgagaccattacctagaacatcctaatcgaaaaattcctctcctcttctctccccgcgcccctccctctcccccaaaaccctaacccatcgtcgaccggtccccgctctcgtggcgccggcaagatgaccctcctcgcagccatcaccaaccccgccgccgactcccgctccggctccagcgagagggctcaccctatcgtgctcaccccgggtgtcacgccgccgccgccgccatcctccacgcttcccaccccaataccgtcttccacctggtcgctctccccagccgaccccaccctcgccaccgccgcttcctacctcgcggccctcgcttgcctcctgctcctccctcccggagctccgcgcccttctcaccacctttatcaccactctgtcacaatccctcgcactcccaaccccgccggggggcctccccgccgccatccgcgctgtcgccccttacttccccgccgcaatccccccccttttggccccccaaggcggaaaacctcgccggggacgaactccttcttggtcctcgggaaatccgaactacctccggaaccggcaacggaaaatatcctcggcccccctgcaaaaggaacggg

SEQ ID NO: 36088 - DNA, 705 bp, Zea mays
  misc_feature: Ceres CLONE 1418950-F
  misc_feature: Encodes the peptide sequence at SEQ ID NO. 36089
aaagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacccgtgggagggcaagggggccaagagcttgagtccaacgccgggcgctccgggctgcttctggcttccggaaagaaaaatgcttaccccgcctgctgggagcaaaattggatggggaattatgccgcccccggctctctgggggcccttcccttgcccccccttaaaaaaagggttattccccaaaaggaagcgcgg

SEQ ID NO: 36089 - protein, 167 aa, Zea mays
  misc_feature: Ceres CLONE 1418950-F
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTPVGGQGGQELESNAGRSGLLLASGKKNAYPACWEQNWMGNYAAPGSLGALPLPPLKKRVIPQKEAR

SEQ ID NO: 36090 - DNA, 730 bp, Zea mays
  misc_feature: Ceres CLONE 1418951-F
  misc_feature: Encodes the peptide sequence at SEQ ID NO. 36091
  misc_feature (402)..(402): n is a, c, t, g, unknown, or other
  misc_feature (403)..(403): n is a, c, t, g, unknown, or other
  misc_feature (406)..(406): n is a, c, t, g, unknown, or other
  misc_feature (411)..(411): n is a, c, t, g, unknown, or other
  misc_feature (414)..(414): n is a, c, t, g, unknown, or other
ggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccataggctgcctaaaagggtatggnnccnccccnacngacaaaaggactgggcgcccaaaaatttggatatccaggaacaaagttactattgaaccaaagggtgatgcaacactccccttagaagatccacatgctgcttcacctggtggggaaagggacgataacaaggatttccctgggagcactattcgggttcggttccttgagtcaagaagcaaagaggcttccgatacccccccacattttaaccttcgttggtggtgtttggataaaaaaaaggagcgcgggtaattggactgcgaaaaggcaaaaggcgctgtcgatcccctcatccaggtttgaccactaaaat

SEQ ID NO: 36091 - protein, 130 aa, Zea mays
  misc_feature: Ceres CLONE 1418951-F
  misc_feature (43)..(43): Xaa is any aa, unknown, or other
  misc_feature (44)..(44): Xaa is any aa, unknown, or other
MAGYMSRGPQNGSVYVCNLPPGTDENMLAEYFGTIGCLKGYGXXPTDKRTGRPKIWISRNKVTIEPKGDATLPLEDPHAASPGGERDDNKDFPGSTIRVRFLESRSKEASDTPPHFNLRWWCLDKKKERG

SEQ ID NO: 36092 - DNA, 527 bp, Zea mays
  misc_feature: Ceres CLONE 1418952-F
  misc_feature: Encodes the peptide sequence at SEQ ID NO. 36093
ggactcccccggggcggccgctctaactagtggatcccccgggctgcagattcgcacaacttacctaacatcctatcaaaaagaactttcgggttgcgtgtccttatttataaatggttcactttttactcaccaaattttgattaatactttgagaaatcaatgctctgttttgtttctcgggaaattatcagagtgagaaaagatcgaggaagatgaagccgggcaggaaacacgttcggagactataaccaccgctagtggtttgcttcctcgagacgtgtcatcccacctcccatctaaaagcaaaggggatccttctagttcaacttcacacaaaaaaacatgggaaccgctcttgtctgaccggtcaaccattcctcattccgtatctcgtatacgccttcttcatactcacttattctgttctcttcatcaaactcttcgctccagcgctgtagatctcccttagctcactctacacacacacacacacacgggtctcgaatcgctcgactagctccagc

SEQ ID NO: 36093 - protein, 65 aa, Zea mays
  misc_feature: Ceres CLONE 1418952-F
DSPGAAALTSGSPGLQIRTTYLTSYQKELSGCVSLFINGSLFTHQILINTLRNQCSVLFLGKLSE

SEQ ID NO: 36094 - DNA, 670 bp, Zea mays
  misc_feature: Ceres CLONE 1418963-F
  misc_feature (190)..(190): n is a, c, t, g, unknown, or other
  misc_feature (202)..(202): n is a, c, t, g, unknown, or other
  misc_feature (228)..(228): n is a, c, t, g, unknown, or other
  misc_feature (229)..(229): n is a, c, t, g, unknown, or other
  misc_feature (549)..(549): n is a, c, t, g, unknown, or other
ctccccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccataggcgacaccgtccccaacctggagctgganctccacccacgngcaagatccgcatccacgaactacgnnttggcgaacggctacgcttaatcatgctgttctgctctacgccaggcccgaattttccacggcccccggtgggtgcacccgaaacgggaaaaaattgggtgcgccgccaaaatggggccgagggggtgttccaccccctaaaaggggaagtttcccgaaaaaaaaaaggggtgggggtgatttatataaagaattctttttgggggggggggtctcttctctgtgtgggcccgacagacaatacatatccgatggattaattctcacccgcccccactcttcaaagctttttgggttttttatcagcaccaacttctttncatctcagccatagtagacacatgtatcgcacaccaaactagtgtgtactggagagtaaaaaaagaaaaacggattggtgaaagttagacaactggtgtcgtcccgactcacctctcaaga

SEQ ID NO: 36095 - DNA, 596 bp, Zea mays
  misc_feature: Ceres CLONE 1418964-F
  misc_feature: Encodes the peptide sequence at SEQ ID NO. 36096
  misc_feature (228)..(228): n is a, c, t, g, unknown, or other
  misc_feature (264)..(264): n is a, c, t, g, unknown, or other
  misc_feature (272)..(272): n is a, c, t, g, unknown, or other
  misc_feature (292)..(292): n is a, c, t, g, unknown, or other
  misc_feature (295)..(295): n is a, c, t, g, unknown, or other
  misc_feature (357)..(357): n is a, c, t, g, unknown, or other
  misc_feature (433)..(433): n is a, c, t, g, unknown, or other
  misc_feature (434)..(434): n is a, c, t, g, unknown, or other
aaagctggagctccaccgcggtggcggccgctctagaactagtggatcccccgggctgcaggaattcgcacgagaccattacctagaacatcctaatcgaaaatctatcatcatccaatccagatcagcaaagcggcagtgcgtagagaggatcgtcgaacagaacagcatgaagatggtcatcgttctcgtcgtgtgcctggctctgtcagctgccagcgcctctgncatgcagatgccctgcccctgcgcggggctgcaggncttgtacngcgctggcccccgcctgacnacnatgatgggcgcccgcgggctgtacccctacccggagtacctgagcagccccattgcaaccgngttgggggggggccttatttcccccggggttggccacccaaccccattttccacccttcccgggaaatggtttccnnccccaattaggttgatggaatggatcccccccccccacacctccaaaaaatatacccttttgggggggcccttcccccaaaaaaaccttttaaaacacctttttatattccaaacccacacctttttttgggcccccgggggttcccccccccggggggttg

SEQ ID NO: 36096 - protein, 142 aa, Zea mays
  misc_feature: Ceres CLONE 1418964-F
  misc_feature (20)..(20): Xaa is any aa, unknown, or other
  misc_feature (32)..(32): Xaa is any aa, unknown, or other
  misc_feature (35)..(35): Xaa is any aa, unknown, or other
  misc_feature (63)..(63): Xaa is any aa, unknown, or other
  misc_feature (89)..(89): Xaa is any aa, unknown, or other
MKMVIVLVVCLALSAASASXMQMPCPCAGLQXLYXAGPRLTTMMGARGLYPYPEYLSSPIATXLGGGLISPGVGHPTPFSTLPGKWFPXPIRLMEWIPPPHTSKKYTLLGGPFPQKNLLKHLFIFQTHTFFWAPGGSPPRGV

SEQ ID NO: 36097 - DNA, 719 bp, Zea mays
  misc_feature: Ceres CLONE 1418974-F
  misc_feature: Encodes the peptide sequence at SEQ ID NO. 36098
  misc_feature (695)..(695): n is a, c, t, g, unknown, or other
ctccccgcggtggcggccgctctagaactagtggatcccccgggctgcaggaattcgcacgagaccattacctagaacatcctaatcgaaaagtggattgtactgttctcagtggattaatagaattggacgctggagatagacccgccggagaagatggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctcttcctcctcgctaccgccgccgccgccggaagcaacaaggctgaggaggtggacgacctccagtaccttattgacaactccgaagacatcccacccaacgaccctgacgggtggcctgagggccgcggcggcggcaactacaacgacgaccttctcttcaagatcaggaccaggacctcccagactacaagccgcaaatcgacaagacccaacgtgtgttcctcaccggcggcaaatttctcctccttcctcggcccccccccgccatggcatggttgaggttctacccccccctgttgtggccactgcccggaagcccccccctgaatacggccccccgccgccgggcattttgtccttncacccaaaaccttaccggttctgt

SEQ ID NO: 36098 - protein, 108 aa, Zea mays
  misc_feature: Ceres CLONE 1418974-F
MGSTRTSHPSFPVLLLFLLATAAAAGSNKAEEVDDLQYLIDNSEDIPPNDPDGWPEGRGGGNYNDDLLFKIRTRTSQTTSRKSTRPNVCSSPAANFSSFLGPPPPWHG

SEQ ID NO: 36099 - DNA, 676 bp, Zea mays
  misc_feature: Ceres CLONE 1418981-F
  misc_feature: Encodes the peptide sequence at SEQ ID NO. 36100
  misc_feature (414)..(414): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacngcctccgtggtggggctggccgtggccacgccggtgttcctgatcttcagccccgtgctcgtccccgccgcgctgctcatcgggacggccgtcatggggttcctcacgtcgggcgcgctggggctcgggggcctgtcctcgctcacgtggctcgccaacacggcgcggcaggcgttccagcgcaccccggactacgtggaagaagcgcaccccaagaatggcgaagccgccggcccacccgggccaccaagaccgcgcaggg

SEQ ID NO: 36100 - protein, 157 aa, Zea mays
  misc_feature: Ceres CLONE 1418981-F
  misc_feature (44)..(154): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSGALGLGGLSSLTWLANTARQAFQRTPDYVEEAHPKNGEAAGPPGPPRPRR

SEQ ID NO: 36101 - DNA, 663 bp, Zea mays
  misc_feature: Ceres CLONE 1418982-F
  misc_feature: Translation starting site: 226
  misc_feature: SWISSPROT Homolog: EC 1.1.1.1 Alcohol dehydrogenase
aagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagct

SEQ ID NO: 36102 - DNA, 647 bp, Zea mays
  misc_feature: Ceres CLONE 1418986-F
  misc_feature: Encodes the peptide sequence at SEQ ID NO. 36103
  misc_feature (483)..(483): n is a, c, t, g, unknown, or other
  misc_feature (543)..(543): n is a, c, t, g, unknown, or other
ggagctccccgcggtggcggccgctctagaactagtggatcccccgggctgcaggaattcgcacgagaccattacctagaacatcctaatcgaaaaacggaaaatcccttcaaaacccctccggtccctcacccccatccgccgccgctttcctcccacggtcccaccacgcgcgcggccggcgggcggccaacggcggggagcagcaccgcgcgatcgtcaccgacgcttccacctacctgtgtcagaacaaggtagcaaaatgaacaaccacctaagcttcgaggagggctggaaagtcctggaacaggggattgtaaaatgctcgaagattttggagtgcaccagtacaaggcctaccgtgaacgaatacatgaactactatgaatgtgcttacaggatggctgtgcagaaacaacattactgtccagaaatgtacaatggttttcagatgatgcttgcagaatgtgtccgcacaatggntctgccccatctcatgcacagcaaaatgacagctttttcagagagcttgtgaaaatgtgntcaaactaatgcatcaggataaaaggggaaattgcctcctcagctattgggaccgctgctatgtggacacaaacaacctaaccatccttaacaaccttggtgct

SEQ ID NO: 36103 - protein, 90 aa, Zea mays
  misc_feature: Ceres CLONE 1418986-F
  misc_feature (74)..(74): Xaa is any aa, unknown, or other
MNNHLSFEEGWKVLEQGIVKCSKILECTSTRPTVNEYMNYYECAYRMAVQKQHYCPEMYNGFQMMLAECVRTMXLPHLMHSKMTAFSESL

SEQ ID NO: 36104 - DNA, 651 bp, Zea mays
  misc_feature: Ceres CLONE 1419007-F
  misc_feature: Encodes the peptide sequence at SEQ ID NO. 36105
  misc_feature (332)..(332): n is a, c, t, g, unknown, or other
  misc_feature (413)..(413): n is a, c, t, g, unknown, or other
ctccaccgcggtggcggccgctctagaactagtggatcccccgggctgcaggaattcgcacgagaccattacctagaacatcctaatcgaaaaactcccatctctcccgtttctctacacttcctgacccagatggcggcggcaccctgctctaccaccttctccggcgacgtgtgggcggagctgcgcctggcctccgccagcgatgtgccgcacatccaccgcctgatacaccagatggccgagttcgagctcctcaccgacctcttcgccgccaccgaagagctgctcacctccacgctcttcccctcgccgacgccgcctcccttcancctcttcacagccctcatccctcgactatcccccctcccccgtcacccccgacccctcggtcaacatcggcctcccggcgncttggactttttcgggttccccgtcggggaaccccgaggcccgccgcctttcgccctcccgggggggaggcgggccccttcacgggccgggtttggggattttggtttcccccaataaatccaactttctcttccaaaacccgggttttaccgtgaaagaaaattttttttgcccccgccccctgggcccccccccggggtctcggccggaaaaaaccttccccccccccccccggag

SEQ ID NO: 36105 - protein, 132 aa, Zea mays
  misc_feature: Ceres CLONE 1419007-F
  misc_feature: SWISSPROT Homolog: EC 2.3.1.110 Tyramine N-feruloyltransferase
  misc_feature (67)..(67): Xaa is any aa, unknown, or other
  misc_feature (94)..(94): Xaa is any aa, unknown, or other
MAAAPCSTTFSGDVWAELRLASASDVPHIHRLIHQMAEFELLTDLFAATEELLTSTLFPSPTPPPFXLFTALIPRLSPLPRHPRPLGQHRPPGXLDFFGFPVGEPRGPPPFALPGGRRAPSRAGFGDFGFPQ

SEQ ID NO: 36106 - DNA, 612 bp, Zea mays
  misc_feature: Ceres CLONE 1419018-F
  misc_feature: Translation starting site: 139
  misc_feature (408)..(408): n is a, c, t, g, unknown, or other
  misc_feature (415)..(415): n is a, c, t, g, unknown, or other
  misc_feature (416)..(416): n is a, c, t, g, unknown, or other
  misc_feature (419)..(419): n is a, c, t, g, unknown, or other
  misc_feature (428)..(428): n is a, c, t, g, unknown, or other
  misc_feature (429)..(429): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (478)..(478): n is a, c, t, g, unknown, or other
  misc_feature (480)..(480): n is a, c, t, g, unknown, or other
  misc_feature (482)..(482): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (498)..(498): n is a, c, t, g, unknown, or other
  misc_feature (505)..(505): n is a, c, t, g, unknown, or other
  misc_feature (507)..(507): n is a, c, t, g, unknown, or other
  misc_feature (510)..(510): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (529)..(529): n is a, c, t, g, unknown, or other
  misc_feature (530)..(530): n is a, c, t, g, unknown, or other
  misc_feature (532)..(532): n is a, c, t, g, unknown, or other
  misc_feature (533)..(533): n is a, c, t, g, unknown, or other
  misc_feature (559)..(559): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (588)..(588): n is a, c, t, g, unknown, or other
  misc_feature (589)..(589): n is a, c, t, g, unknown, or other
ggagctccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggggcgggaccgactatgggacggacgaacagcaagaatctccccccccgaacgaaagaaattcccccccnccccccnnttnccccccccnnaaaaaagggggggggggggggggggccccccccnnnggggggggggggngngngggnnnnnnnnnnncnccgcccncnccncccccnnncccccccgccnncnnccccggcccccccccccccccccccncnnnncnnnnnnnnnnnnnnnnggggggnnggggggggggggggggggggggg

SEQ ID NO: 36107 - DNA, 810 bp, Zea mays
  misc_feature: Ceres CLONE 1419021-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (320)..(320): n is a, c, t, g, unknown, or other
  misc_feature (321)..(321): n is a, c, t, g, unknown, or other
  misc_feature (336)..(336): n is a, c, t, g, unknown, or other
  misc_feature (340)..(340): n is a, c, t, g, unknown, or other
  misc_feature (344)..(344): n is a, c, t, g, unknown, or other
  misc_feature (351)..(351): n is a, c, t, g, unknown, or other
  misc_feature (355)..(355): n is a, c, t, g, unknown, or other
  misc_feature (356)..(356): n is a, c, t, g, unknown, or other
  misc_feature (374)..(374): n is a, c, t, g, unknown, or other
  misc_feature (576)..(576): n is a, c, t, g, unknown, or other
  misc_feature (626)..(626): n is a, c, t, g, unknown, or other
  misc_feature (639)..(639): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaagactgggggacctccaccgnncggtggggcggccgnctcntagnaactagntggnnatcccccgggctgcaggnaattcgcacgagaccattacctagaacatcctaatcgaaaaatctctctcttctcctcgcctcgccttggtgttcacgccgtcgctagcgcctgccgcggcgaacttctgccctcccggcgccaggctcgggtcgtcgtcggccaggcagctgctacgcgtgaacacggtcacaccagtacggcagtaccacgccgacgtgnaacggtgaactcgtggaagaaacagagccgccactggaggaaaaccctancgaaccggcggcngtgctacccggtggacattggtcccccccttggcccccttccattcccttggacccaaacggcgccccgcctgggaaggaaaccccagccccccttattccgaaaacaagggggcaaatctttgggcggccccttgtgggaaaacttttccgccccaaaaaaagggggcag

SEQ ID NO: 36108 - DNA, 672 bp, Zea mays
  misc_feature: Ceres CLONE 1419022-F
  misc_feature: Encodes the peptide sequence at SEQ ID NO. 36109
ggagctccccgcggtggcggccgctctagaactagtggatcccccgggctgcaggaattcgcacgagaccattacctagaacatcctaatcgaaaaattccactgtttctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaactagggagtcctcgcccttcgagctcccccttggaaagtacggcctcgacggagagaaggcgtgcgccgagctcctgagcttttccgattccagtggctctccacaggtgaccatttttgttctgccagactataagccacctcttgcagcgtgtgttgtaaatggggtcttggaactgatttcttctgaagctacctccactgagcgaactctaatttgtccatacatcacaagatcgtcaagctatcatcatggaaccggaccatgcacaaaggcatcaactgtacttcctggggctgaaaaagggggaacaactgacctaaccccccctggtgggtgggggggacccccaaacccccccacaccccttgcaaaaaccaa

SEQ ID NO: 36109 - protein, 158 aa, Zea mays
  misc_feature: Ceres CLONE 1419022-F
MRVAPRVLFLVRDAAGYGAALADALRPPPGLTRESSPFELPLGKYGLDGEKACAELLSFSDSSGSPQVTIFVLPDYKPPLAACVVNGVLELISSEATSTERTLICPYITRSSSYHHGTGPCTKASTVLPGAEKGGTTDLTPPGGWGGPPNPPTPLAKT

SEQ ID NO: 36110 - DNA, 650 bp, Zea mays
  misc_feature: Ceres CLONE 1419023-F
  misc_feature: Encodes the peptide sequence at SEQ ID NO. 36111
  misc_feature (271)..(271): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (336)..(336): n is a, c, t, g, unknown, or other
  misc_feature (337)..(337): n is a, c, t, g, unknown, or other
  misc_feature (367)..(367): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (407)..(407): n is a, c, t, g, unknown, or other
  misc_feature (413)..(413): n is a, c, t, g, unknown, or other
  misc_feature (418)..(418): n is a, c, t, g, unknown, or other
caaagtggagtcacgcggtggcgggggtctgaactagaggatcgccgggctgctgaattctccgagagcttacctagaaatcctaatcgataatatcgaaaaaaatactcgtttttttctatcgtaggctcttgaggagctatttcatcccctcgaattcgaagagcaacagacaaagtaaaggggggcatggtagcgagagcagccggagccggccggagggggggaaaaaagagggagagggggccgggcaggcggggcgaggaagaanaaaaaaattgtggagagtggacggcgggggggcggtgattcgcgcgcaannnnaannnnnnnntnntcctcccgtcggacgagagcgaccaggtcnccccccgcgcnnnnnnnnnnntgaaggggcgggggtcctnacgganctggnccgccgaggtggctggagctggccggcaacgcggccaaggacaacaagaagacccgcatcatcccgcgccacgtgctcctggccatccgcaacgacgaggagctcggcaagctgctgtccggcgtcacatcgcccacggcggcgtcctccccacatcaaccggtgctctgcccagagaccgctgagaggcgggggcaggaggccagtcgccagaagccgccagtccccagaa

SEQ ID NO: 36111 - protein, 30 aa, Zea mays
  misc_feature: Ceres CLONE 1419023-F
QSGVTRWRGSELEDRRAAEFSESLPRNPNR

SEQ ID NO: 36112 - DNA, 650 bp, Zea mays; identical to SEQ ID NO: 36110
  misc_feature: Ceres CLONE 1419023-F2
  misc_feature (271)..(271): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (336)..(336): n is a, c, t, g, unknown, or other
  misc_feature (337)..(337): n is a, c, t, g, unknown, or other
  misc_feature (367)..(367): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (407)..(407): n is a, c, t, g, unknown, or other
  misc_feature (413)..(413): n is a, c, t, g, unknown, or other
  misc_feature (418)..(418): n is a, c, t, g, unknown, or other

SEQ ID NO: 36113 - DNA, 501 bp, Zea mays
  misc_feature: Ceres CLONE 1419031-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (360)..(360): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatcccccgggctgcaggaattcgcacgagaccattacctagaacatcctaatcgaaaaatccacctggtcctcgcgtctcccttcccagatccatcgactcgctcgggccgcccctcccgtcgtccccgttcgaaggtgcggcagccggcaggcgagcgatttgattcgacatgaatcccgagtacgactaccctttcaaacttnctggctattgtgattctgggtgttgggaaatcatgcttggcttctcagaatttgcagaccgattccttattttggacaggttttattcagccccaaattggggggttgaaatttcaaaaaatttcccccccaggggggggg

SEQ ID NO: 36114 - DNA, 619 bp, Zea mays
  misc_feature: Ceres CLONE 1419037-F
  misc_feature: Encodes the peptide sequence at SEQ ID NO. 36115
  misc_feature (575)..(575): n is a, c, t, g, unknown, or other
aaagctggagctccccgcggtggcggccgctctagaactagtggatcccccgggctgcaggaattcgcacgagaccattacctagaacatcctaatcaaaaaatcttgctctgaacgcattcctcccatctcccaagacctcctcagaaccgagaagcgcagctgcggccatggacgccaccggcactggatctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgcccaaggacacaagaagacgcgcatcgtcccgcgccacgtgctgctggcgatccgcaacgacgaagagctcgggaagctgctgaccggcgtgacccatcgccacgggcggcgtggtgcccaacatcaaccccgtcctgctgcccaagagaccgcngaaaaaggcgtccccagcgcggaagcagtaaggcaagtcgccca

SEQ ID NO: 36115 - protein, 149 aa, Zea mays
  misc_feature: Ceres CLONE 1419037-F
  misc_feature (31)..(104): Pfam Name: Histone Pfam Description: Core histone H2A/H2B/H3/H4
MDATGTGSGGKAKKGAAGRKAGGPRKKSVTRSVKAGLQFPVGRIGRYLKKGRYAQRVGSGAPVYLAAVLEYLAAEVLELAGNAAQGHKKTRIVPRHVLLAIRNDEELGKLLTGVTHRHGRRGAQHQPRPAAQETAEKGVPSAEAVRQVA

SEQ ID NO: 36116 - DNA, 636 bp, Zea mays
  misc_feature: Ceres CLONE 1419038-F
  misc_feature: Encodes the peptide sequence at SEQ ID NO. 36117
  misc_feature (585)..(585): n is a, c, t, g, unknown, or other
  misc_feature (587)..(587): n is a, c, t, g, unknown, or other
  misc_feature (588)..(588): n is a, c, t, g, unknown, or other
  misc_feature (600)..(600): n is a, c, t, g, unknown, or other
  misc_feature (601)..(601): n is a, c, t, g, unknown, or other
  misc_feature (606)..(606): n is a, c, t, g, unknown, or other
  misc_feature (618)..(618): n is a, c, t, g, unknown, or other
  misc_feature (619)..(619): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaacctaggactgggcacaacatgtctccatccgacgacggcgaggaaaccctcgccgcgctcatagaactgtctagaacgccggagggccgggagggtctcaccgacgtgctcatcgacaccctcttcctcctcccggcctccccgccgcgcctcttgctcctccgcctacgcctcctccgcaacctcctcgccggcgatgagctcaaccactacgccttcatcgagcactccggccccgccgccgtcgccgcctccgtgctctccttcccctcgctcgcccccgacgtggcgcgcgccgcgctccaggcgctcgggaacgccgcgctcgccggggagctccaccgccgacgccgtctgggagggcgctccttccctgaaggcctgcgggtgttcccggggctcaggggaccaagggaaaccccgggggaacccccccccgggagaggggggtgggtccccccccaaacaaaacatcttttctntnncccccttcgggnnggggnagacaggcacgnngcggcgctccgcccnct

SEQ ID NO: 36117 - protein, 171 aa, Zea mays
  misc_feature: Ceres CLONE 1419038-F
  misc_feature (155)..(155): Xaa is any aa, unknown, or other
  misc_feature (156)..(156): Xaa is any aa, unknown, or other
  misc_feature (160)..(160): Xaa is any aa, unknown, or other
  misc_feature (162)..(162): Xaa is any aa, unknown, or other
  misc_feature (166)..(166): Xaa is any aa, unknown, or other
MSPSDDGEETLAALIELSRTPEGREGLTDVLIDTLFLLPASPPRLLLLRLRLLRNLLAGDELNHYAFIEHSGPAAVAASVLSFPSLAPDVARAALQALGNAALAGELHRRRRLGGRSFPEGLRVFPGLRGPRETPGEPPPGRGGWVPPQTKHLFXXPLRXGXDRHXAALRP

SEQ ID NO: 36118 - DNA, 717 bp, Zea mays
  misc_feature: Ceres CLONE 1419052-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (308)..(308): n is a, c, t, g, unknown, or other
  misc_feature (320)..(320): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctgggactccaccgcggtggcggccgctctagaactagtggatcccccgggctgcaggaattcgcacgagaccattacctagaacatcctaatcgaaaaactgccatgttcgcctcgcgctcctcacccccgctatccccctccgtgtcggcgtgcgccgacggcatctttgccagtctcaacgattttatccnttcgtctgctanggccttgtcaaatcgccgcccacgcgaactcgcgccgctgccatgggtcgctcgggcacccaacatcttcctaaaaaatgttcaaactggcaaccaaaaaatccttcctcctaaccccgactcttccacaatccaaactgggtgcggcgttaaaccggaaaaaaaatttttaaacccggttgggcccggggctggcccctaggggtttaaaaatccaaaaacaccctccggccccaaattaaatttgaaaaaattttgtgccccaaaaattgttttcccccaaattgaaaaacttttttccaaaccctttttttttgggggggaagggggggaaaaataccccgcgcacaacaaattccccaaaatttttttcccccccccccgggggggaatatta

SEQ ID NO: 36119 - DNA, 664 bp, Zea mays
  misc_feature: Ceres CLONE 1419059-F
  misc_feature: Encodes the peptide sequence at SEQ ID NO. 36120
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaagtagtaaaaccaggtaggtgtggctggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcagataggcgctgtggcgtacatagagcccggnnnnnnnnnnn

SEQ ID NO: 36120 - protein, 166 aa, Zea mays
  misc_feature: Ceres CLONE 1419059-F
  misc_feature (15)..(166): Pfam Name: Ras Pfam Description: Ras family
  misc_feature (15)..(128): Pfam Name: Miro Pfam Description: Miro-like protein
MSAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIEPG

SEQ ID NO: 36121 - DNA, 607 bp, Zea mays
  misc_feature: Ceres CLONE 1419060-F
  misc_feature: Encodes the peptide sequence at SEQ ID NO. 36122
  misc_feature (490)..(490): n is a, c, t, g, unknown, or other
  misc_feature (495)..(495): n is a, c, t, g, unknown, or other
tggagctccccgcggtggcggccgctctagaactagtggatcccccgggctgcaggaattcgcacgagaccattacctagaacatcctaatcgaaaaattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacnagggncaccattggaggtgttgggccccgaccaggaaacccccccccccggggcccccaaaaaaaccctgcgaaaaagcgtcgcctaaaaaaaaaaaaggggggccccttttaaaag

SEQ ID NO: 36122 - protein, 144 aa, Zea mays
  misc_feature: Ceres CLONE 1419060-F
  misc_feature (11)..(144): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (106)..(106): Xaa is any aa, unknown, or other
MSAYCGKYADELIKNAAYIGTPGKGILAADESTGTIGKRLSSINVENVEENRRALRELLFCCPGALQYISGVILFEETLYQKTKDGKPFVDVLKEGGVLPGIKVDXGHHWRCWAPTRKPPPPGPPKKPCEKASPKKKKGGPLLK

SEQ ID NO: 36123 - DNA, 654 bp, Zea mays
  misc_feature: Ceres CLONE 1419064-F
  misc_feature: Encodes the peptide sequence at SEQ ID NO. 36124
  misc_feature (543)..(543): n is a, c, t, g, unknown, or other
  misc_feature (604)..(604): n is a, c, t, g, unknown, or other
caaagctggagctccccgcggtggcggccgctctagaactagtggatcccccgggctgcaggaattcgcacgagaccattacctagaacatcctaatcgaaaaactcctcatcgccacaagtgaagtcaccgacgcacgcacggctgcagcgcgctcctactctcccgcgaccgccaccggggaggggcaatagaatatagcgaggacagccaatgcaggccgccgtcaacaccaccactgtcggcgctcacccgcacccaacaaagtcctcgttcctccgtccatcccctccttgccgcgtctacttccacgcttctccacgcccgaaccatagggcgatcgccatggccagcaagtcgcagctgcaggagcaactgatcatcactcgccccaacgactggcacctccatcttcgcgaaggcggtgtcctcgaggctgtagtgccacacagcgcgaggcattttgggagggccatcatcatgcccaacctgaagccgccggtgaccacaacggcgcgggccatggagtacagggaggagatnatgagggcgctgccgccagggagtagcttcgagccgctcatgacactatacctcacagacnacacaagcccagaggagatcaagctcgcaagaaagagtggtataatcttt

SEQ ID NO: 36124 - protein, 103 aa, Zea mays
  misc_feature: Ceres CLONE 1419064-F
  misc_feature: SWISSPROT Homolog: EC 3.5.2.3 Dihydroorotase
  misc_feature (66)..(66): Xaa is any aa, unknown, or other
  misc_feature (87)..(87): Xaa is any aa, unknown, or other
MASKSQLQEQLIITRPNDWHLHLREGGVLEAVVPHSARHFGRAIIMPNLKPPVTTTARAMEYREEXMRALPPGSSFEPLMTLYLTDXTSPEEIKLARKSGIIF

SEQ ID NO: 36125 - DNA, 729 bp, Zea mays
  misc_feature: Ceres CLONE 1419066-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (315)..(315): n is a, c, t, g, unknown, or other
  misc_feature (320)..(320): n is a, c, t, g, unknown, or other
  misc_feature (321)..(321): n is a, c, t, g, unknown, or other
  misc_feature (326)..(326): n is a, c, t, g, unknown, or other
  misc_feature (328)..(328): n is a, c, t, g, unknown, or other
  misc_feature (340)..(340): n is a, c, t, g, unknown, or other
  misc_feature (341)..(341): n is a, c, t, g, unknown, or other
  misc_feature (360)..(360): n is a, c, t, g, unknown, or other
  misc_feature (366)..(366): n is a, c, t, g, unknown, or other
  misc_feature (367)..(367): n is a, c, t, g, unknown, or other
  misc_feature (379)..(379): n is a, c, t, g, unknown, or other
  misc_feature (386)..(386): n is a, c, t, g, unknown, or other
  misc_feature (392)..(392): n is a, c, t, g, unknown, or other
  misc_feature (404)..(404): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggggctcaccgcggtggcggccgctctagactagtggatcccccgggctgcaggaattcgcacgagaccattacctagaacatcctaatcaaaaaatcttgctctgaacgcattcctcccatctcccaagacctcctcagacccgagaagcgcagctgcggccatggacgccaccggcactggatctggaggaaggcgaanaaggnnagcgncngtcgcaaggccnngcggcccgagaaagagtcngtgacnnagtcccgtgaanggcgggnctcagntcccccgtcggncggattcgggggcttacctcagaaagggcccctaaccccaacccggtcggaaagggtggccccccttttaacttggggggcggtcccggggaatacccccccccccttaaggccccgggaaattcccccgggaaaacttttcccaggggaaaaaaaaaaaaaaaacgcttttttccccccgcccccgtggggtttggggggaatccccccacaaacaaaaaaaactcccggaaaaaatttttaacacccgggtgacacctcccccccccgggggggggggggttgtccacaaaaaaaaaaccgcggggggtctgtgccccaaaaa

SEQ ID NO: 36126 - DNA, 667 bp, Zea mays
  misc_feature: Ceres CLONE 1419076-F
  misc_feature: Encodes the peptide sequence at SEQ ID NO. 36127
aaagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtgccaaggagatccctgatgattattttgtttgtttggttggagacatgattactgaggaagctctaccaacataccagactatgcttaacaccctcgac

SEQ ID NO: 36127 - protein, 148 aa, Zea mays
  misc_feature: Ceres CLONE 1419076-F
  misc_feature: SWISSPROT Homolog: EC 1.14.19.2 Acyl-[acyl-carrier-protein] desaturase
MALRLHDVALCLSPPLAARRRSGGSFVAVASMTSAAVSTRVENKKPFAPPREVHVQVTHSMPSHKIEIFKSLDDWARDNILTHLKPVEKCWQPQDFLPDPASEGFHDEVKELRERAKEIPDDYFVCLVGDMITEEALPTYQTMLNTLD

SEQ ID NO: 36128 - DNA, 642 bp, Zea mays
  misc_feature: Ceres CLONE 1419088-F
  misc_feature: Encodes the peptide sequence at SEQ ID NO. 36129
  misc_feature (515)..(515): n is a, c, t, g, unknown, or other
aaagctggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaagatttntggttttgcatcaaaaatacaataaccagttccggcccggtttaacccgagtttttgggaaaccccctctaggagaaagagacttgtcccccccgggagaaaaaacccccccccggtgttttaaaaa

SEQ ID NO: 36129 - protein, 80 aa, Zea mays
  misc_feature: Ceres CLONE 1419088-F
  misc_feature (18)..(81): Pfam Name: Alba Pfam Description: Alba
  misc_feature (73)..(73): Xaa is any aa, unknown, or other
MDRYQRVEKPPPEAAAIGENEIRITTQGLVRNYVTYATSLVQEKQVKEIVLKAMGQAISKAVAIAEIIKKKIXGFASKIQ

SEQ ID NO: 36130 - DNA, 646 bp, Zea mays
  misc_feature: Ceres CLONE 1419114-F
  misc_feature (350)..(350): n is a, c, t, g, unknown, or other
  misc_feature (404)..(404): n is a, c, t, g, unknown, or other
tctgaactagtggatcccccgggctgcaggaattcgcacgagaccattacctagaacatcctaatcgaaaaagttccttcgcgttgcccgcgactctctccgtcctcctactgcccacccgactcacacgcttggcacgcgcgtgcttcaacacgtccgtcgcctatctctcggactgcctgatagatttggttgccccggttccagcaatggcggtccacgcgcattatatccaccactaccagggggagtcccctttcctcgtcagcggctcgccgaagggctgcccgcgtggccgcagccatggagctgcttcatctcgggaagaaggaggctattggggccgtggnaggattagggtccggccttctttttggactttttgcgtgccacatgcgggggtnggagaagcgggaggggaaggaacaacccctgccctcccaatttttctctccaaagacagcatccccagcgcaggggcaccaagtcaatccgcctgggaaaaacttaagaagcccggaccggcaaataggctccccgccccgacttccacctagggccccgggagcaattcgtcccaaaaccctcccctggcctggggccttgggccccaggggtccccctccccaaaaaaaaccttccccag

SEQ ID NO: 36131 - DNA, 746 bp, Zea mays
  misc_feature: Ceres CLONE 1419116-F
  misc_feature (697)..(697): n is a, c, t, g, unknown, or other
aagctggagctccccgcggtggcggccgctctagaactagtggatcccccgggctgcaggaattcgcacgagaccattaccagaacatcctaatcgaaaaatcaccaccactgggtcttcagaccattagcttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccaactgcatggaacctgcggcgttggcagcaccccaaacactgagccagatgatgagaaatcttcaaatagcttaattattgttgttgagtcctggcatgaccgactccaaaggtgggaaaccgggtttaaggcctccggtttaactttcgaagctccgatggtttaagggaagaaagaaaactaggttggctcntaggctcgaatgttttgttttcgtacccctttttttatctttttcttta

SEQ ID NO: 36132 - DNA, 724 bp, Zea mays
  misc_feature: Ceres CLONE 1419121-F
  misc_feature: Encodes the peptide sequence at SEQ ID NO. 36133
ccgctctatatctagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcacgagggcccccgtgggaggcgaagcaggcgctctactcgagggacctcgctcgcaacctgcgcttcgcctccaacttcgacctcttcaaggctgctgcggccgactggcgcgacacgctcttcgtgctaggtggctcctaacggggccacaatttttgtcgcccccaaaaaaagggttttccgcgcctttcccccgggccggggaaaatattggcgtttttaaaagcccaaaccggggg

SEQ ID NO: 36133 - protein, 201 aa, Zea mays
  misc_feature: Ceres CLONE 1419121-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFTRAPVGGEAGALLEGPRSQPALRLQLRPLQGCCGRLARHALRARWLLTGPQFLSPPKKGFSAPFPRAGENIGVFKSPNRG

SEQ ID NO: 36134 - DNA, 692 bp, Zea mays
  misc_feature: Ceres CLONE 1419125-F
  misc_feature: Encodes the peptide sequence at SEQ ID NO. 36135
aaagctggagctccccgcggtggcggccgctctagaactagtggatcccccgggctgcaggaattcgcacgagaccattacctagaacatcctaatcggaaactccctctcctctcgtccatccgttcctcccttcccctgcttcccggctctccctcccccccatccctgcacgccccttttcatgcgcgaggaggggccgtggggaccaccaccagcacctccatccgcgcgcatctcgcggtggtgctcctcctcctcctccccctgctcccggggcgggcgctctcctgttcctcctcctcctgctgctggtgccagggccgggagggcggcgcggaggtggcgctcatggggctcgccggggacgggtcggcggacaccgccaacctcagtaatagtgaaaatggtcggttcagttatggagttgcaagttctcccgggaaaagagcatcgatggaggacttctatgaggcaaggatagacgacgttgacggagagaaagttggaatgtttggtgtgtatgatggtcatggaggaatcagaacagctgagtacgttaagcagcatctttttcagcaatttatccaacaccccaaagtcatcactgataccaaggcccctattgctaaaactttccaaccgcccaaattccgaaattctggaaagctgataaccctccaaacctcaaa

SEQ ID NO: 36135 - protein, 113 aa, Zea mays
  misc_feature: Ceres CLONE 1419125-F
  misc_feature: SWISSPROT Homolog: EC 3.1.3.16 Phosphoprotein phosphatase
MGLAGDGSADTANLSNSENGRFSYGVASSPGKRASMEDFYEARIDDVDGEKVGMFGVYDGHGGIRTAEYVKQHLFQQFIQHPKVITDTKAPIAKTFQPPKFRNSGKLITLQTS

SEQ ID NO: 36136 - DNA, 714 bp, Zea mays
  misc_feature: Ceres CLONE 1419127-F
  misc_feature: Encodes the peptide sequence at SEQ ID NO. 36137
aaagctggagctccccgcggtggcggccgctctagaactagtggatcccccgggctgcaggaattcgcacgagaccattacctagaacatcctaatcgaaaaagtcgagctctttcccttctcgcttcaaaccaaaccaaatcggagtggcggagcaaaacgatccgtagcctcgcttgccttcgattcagctcgaccagggcactaaccgggaaggcaatgccgcgcaagtcgcgagatctgtagcgccaatcggcttcaccggcggcggggcgggcatggaagcgcagaacggctcctgcggaggggcgcccgtggaccgtggtgctcaacgtgtacgacctgacgcccatgaacaactacctctactgggtcggcctcggtattttccactctggaatcgaaagtcatggcatggagtacggatttggagcacacgagtttccgggcagtggaatatttgaggtggaaccgaaaagctgtcctggtttcatctacagaagatctgggtggagggcacaactgacttgtctaaagcagagttccctccttcattgaaaatctggcggaaagtccaccaccaccctttcttttgatctcgaagactgcaaccttttacaaaaaattctgtaaaaatttaccaaaaaaaaaaccccggggccggaaaacccttaaaaaagaggggccctttttcaatggcttctccccaaaaag

SEQ ID NO: 36137 - protein, 68 aa, Zea mays
  misc_feature: Ceres CLONE 1419127-F
MNNYLYWVGLGIFHSGIESHGMEYGFGAHEFPGSGIFEVEPKSCPGFIYRRSGWRAQLTCLKQSSLLH

SEQ ID NO: 36138 - DNA, 736 bp, Zea mays
  misc_feature: Ceres CLONE 1419131-F
  misc_feature: Encodes the peptide sequence at SEQ ID NO. 36139
aaagctggagctccccgcggtggcggccgctctagaactagtggatcccccgggctgcaggaattcgcacgagaccattacctagaacatcctaatcgaaaaaaccaaggctgcgtttctagcagccaaactctcatctttatgaatatcagttttataaacatttaactcttgcagacaatctcagcttccttcttctctttactttcttgttcaataaagctttaataagctatctccatttctgtttaaataaagctctttgagcattttgtacatttgttctcatggtatcagagcatcacggactacatcatatggcgaggacctcgttcctgcagaagctggagcacagggtggaggcgtcggccgccgacttgcagcacatcgagtccatcgccctcgacaccgtctccttcgaggagctcctcggccactgcggcgaggcgctcaaagtctacgcgcgccacgccgacgccctccagtcgcacctcgcttcctttggctacgagcccccggacgcacaacaccccgtgatcgatgtggatgtggaagatggagatgtcgggaaggttggggaccctggagatagatgcctcagcgtgtcgcgttcagtgctcaggtcgggtaagcgggcggtttgatgccacagcgatgcgatattttgagagtcactgaaggatcttggggttttcagatgcttgtctagccactctttcttctgagggcgcacatt

SEQ ID NO: 36139 - protein, 108 aa, Zea mays
  misc_feature: Ceres CLONE 1419131-F
MARTSFLQKLEHRVEASAADLQHIESIALDTVSFEELLGHCGEALKVYARHADALQSHLASFGYEPPDAQHPVIDVDVEDGDVGKVGDPGDRCLSVSRSVLRSGKRAV

SEQ ID NO: 36140 - DNA, 889 bp, Zea mays
  misc_feature: Ceres CLONE 1419131-R
ttgggtaccgggccccccctcgaggtcgacggtatcgataagcttttttttttttttttttattataatactaagatttaagatttcttcacaatttaagatttaacaataagatttaaaaattgttttgaatttggttcataacatacgacgaatccatttgagaagcaaaacaagtaccaaaagaagaaaagagttcaaagcagagcttaatattccaacaacaaaagacgaaacagattgtaaaaccaaaatctttcactaaacatgaaattgtttcaagcattatgataatattattactggctagcaccgagccatttagtgaagttatcgaactcggtgtagtcgctgtcggagatcatagtctggtaccacgccttccctgcggccttgatcgccaatgactcctccttggtgacagtcttcctcttcttggtgagcttctccttcttagccttaaccctctgcgcctccgccaacaacgacatcctcttcgcagtcttagcatacgggttcaacttcagcatcacattcaaattcttcaaaggattcttcttcatcacagccctcttcgcatccttcttaatcggcttcaccacactctggacctcatcagagttaataatcctcgccaaatcaggattcaccatcttcgccctaaggagcaaatacccctttcttctttctccgaggggcttcctcaaacgaatccaatagatcccccctcaaggcttctcgaaaagacacctcctttggccccaaaaccacaaaacctccccggaaattggaccaccccggggaggcaaaggctttttaacctaggttttaaacccctctctcccccggtgggcgaaaaggcttctaaacaccctggggagaagagttg

SEQ ID NO: 36141 - DNA, 732 bp, Zea mays
  misc_feature: Ceres CLONE 1419135-F
  misc_feature: Encodes the peptide sequence at SEQ ID NO. 36142
aaagctggagctccccgcggtggcggccgctctagaactagtggatcccccgggctgcaggaattcgcacgagaccattacctagaacatcctaatcgaaaagaaagtttcgaacaaaagtccacaaatccccttcgccgtctccggcgagccccacccctcatcgccgccgggccaaagagacagtgagaggggggatggatcagtccatcagagccgcatgcgagttcctctcgtcggtgctaaaccacgctgagtcctcgtcccgcgagctcgccgacgccgtctcccaacgccccgtccacctcgagatcacggacaaccgctaccaggattgcttctgaggggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaattgaggtccctagtgaagaagtggcagacattaatcgaagcccatgttgatgtcaagacaaccgacaactacatgttgcgtttgttctgcatcggcttcaccaagaggcgcccaaaccaggtcaagagaacctgctatgctcaggcatcccagatccgtcagatccgcccgtagatggttgagattatgatcaacccagcttctacatgtgaccctgaaagacttgtttcgaagtc

SEQ ID NO: 36142 - protein, 64 aa, Zea mays
  misc_feature: Ceres CLONE 1419135-F
MNFTTDKLRSLVKKWQTLIEAHVDVKTTDNYMLRLFCIGFTKRRPNQVKRTCYAQASQIRQIRP

SEQ ID NO: 36143 - DNA, 739 bp, Zea mays
  misc_feature: Ceres CLONE 1419137-F
  misc_feature: Encodes the peptide sequence at SEQ ID NO. 36144
acaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgcaccgtcgcagcttccgctggcagcagctgcagctcccaaccgtgccgcggcagcgagctcgcgctgccgcacgatggg

SEQ ID NO: 36144 - protein, 108 aa, Zea mays; identical to SEQ ID NO: 16131
  misc_feature: Ceres CLONE 1419137-F

SEQ ID NO: 36145 - DNA, 707 bp, Zea mays
  misc_feature: Ceres CLONE 1419140-F
  misc_feature: Translation starting site: 181
  misc_feature: Pfam Name: Ribosomal_S19 Pfam Description: Ribosomal protein S19
ctccccgcggtggcggccgctctagaactagtggatcccccgggctgcaggaattcgcacgagaccattacctagaacatcctaatcgaaaataaaccctacccgactccgccgccgcccgccgctccgcctcagcgcatagcccgccgcgacctcatcgatcaccttcaactttcaatcatggcggacgtcgatgtcgaaccggaggttgccgccggagctcccaagaagaggacgttccgcaagtacagctaccgcggcgtcgacctagatgcgcttctcgacatgtccacggacgaccctcgtcagctcttccccgcgcgcgccaggagaaaggtccagaggggtctgaagaagaagcccatggcgctcatcaggaagctgcgcaaggcgaaaaaagatgctcctgctggtgaggaacccagagccagtcaagaccatctcccgtaacctgatcattgtccctgaaatgattggaaacattgttggggttaaaacgggaaaaccttcaacagtttaaaacaacccggaaggaacggcgccaccctggggagattccccccccccaaaaccggaaaaaatgggaggccccggatttgggcccccccccccccggggtttttccccccaaaaaggggggtaccccggttcttttatcccccccaaaaaaaagggggagagggttctcccccctttctccctgtttg

SEQ ID NO: 36146 - DNA, 735 bp, Zea mays
  misc_feature: Ceres CLONE 1419151-F
  misc_feature: Encodes the peptide sequence at SEQ ID NO. 36147
  misc_feature (502)..(502): n is a, c, t, g, unknown, or other
aaaagctggagctccccgcggtggcggccgctctagaactagtggatcccccgggctgcaggaattcgcacgagaccattacctagaacatcctaatcgaaaaaaaaggtatcttgcaatcacaacgaacaaaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgacctttcacttcgtcaagaaacgcagacggtcgcgaccatcgtggggtgccaagaaagacgagctcctgggcctgatcgagnaccatggcgcgccctgccctgcgtctgcgtctgcctaaaggaaatcggatcaatctccccctcaaataagggcccccacctagggctgtaaaatgttgcccttaaaaatttccgggtttttccctttggggggccatttggaaacaaaaaaaagtttgtttttcctccggatttcggaggggattttaacccggggaacttgtgttggggtttaaaaaaaaaaaaaaaaaact

SEQ ID NO: 36147 - protein, 122 aa, Zea mays
  misc_feature: Ceres CLONE 1419151-F
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (111)..(111): Xaa is any aa, unknown, or other
MASEQGVVIACHSKAEFDAHMTKAQEAGKLVVIDFTAAWCGPCRAIAPLFVEHAKKFTQVVFLKVDVDEVKEVTAAYEVEAMPTFHFVKKRRRSRPSWGAKKDELLGLIEXHGAPCPASASA

SEQ ID NO: 36148 - DNA, 729 bp, Zea mays
  misc_feature: Ceres CLONE 1419152-F
  misc_feature: Encodes the peptide sequence at SEQ ID NO. 36149
aaagctggagctccccgcggtggcggccgctctagaactagtggatcccccgggctgcaggaattcgcacgagaccattacctagaacatcctaatcgaaaaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaagggtgtggcgatcaatttcgtgcgcaaggatgacatccgtatactgagagatatagagcagtactacagcacacaaattgacgagatgccaatgaatgttgctgatcttatttgagcagcagaaagatcaagagaggaactacttgtgttgacttgaggcccttgtcgcgagtgtggctgtaaactggatcaaatgggctttgtatgtggtcggggaacaaagatcatttccgcttttgcctgtttcctatcggggacccccccttgggaaagccaaatccccaagggacctttcccgggttgccccccactggaaaacaatgtctaccgcgactttttccaagaccattttgctcccagggggttatttcaaacttcttaatggaatgtcaaagtacttggaacactccaagttttttgccaaagctaacaacgggggaactaacc

SEQ ID NO: 36149 - protein, 92 aa, Zea mays
  misc_feature: Ceres CLONE 1419152-F
  misc_feature (1)..(53): Pfam Name: Helicase_C Pfam Description: Helicase conserved C-terminal domain
MGEFRSGATRVLITTDVWARGLDVQQVSLVINYDLPNNRELYIHRIGRSGRFGRKGVAINFVRKDDIRILRDIEQYYSTQIDEMPMNVADLI

SEQ ID NO: 36150 - DNA, 708 bp, Zea mays
  misc_feature: Ceres CLONE 1419160-F
  misc_feature: Encodes the peptide sequence at SEQ ID NO. 36151
  misc_feature (708)..(708): n is a, c, t, g, unknown, or other
aagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttaggggtggtatgcagatctttgtgaaaacccttactggcaagaccatcactctn

SEQ ID NO: 36151 - protein, 167 aa, Zea mays
  misc_feature: Ceres CLONE 1419160-F
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITL

SEQ ID NO: 36152 - DNA, 666 bp, Zea mays
  misc_feature: Ceres CLONE 1419169-F
  misc_feature (33)..(33): n is a, c, t, g, unknown, or other
aaagctggagctccccgcggtggcggccgctcnaatcccaaaggaggccccgggctgcaggaattcccacgagaccattacctagaacatcctaatcgaaaacttcaaaaatcaagttgattatgcggataccgcaaacactgcaaattcggttgttccctacccttctagagtaatctctccacacacacactcacacgctgctgccggctgccctcctcccgccccactcgtcccctccgaaccaagtccgatccatccatccccaaatttctcctctcagcgcgtggggcagtggcggcggcagcgtgggcgcgcggaccgctacgggcacgggagcagcggtggctgcgcaggcagctgtcagcatgcggcatggtgactacgggagcccaggcggcgccggtgcggctgcagccggcggcgggcgaccgtgaggcggctgcgggagcggtgaagtccggtggcgcctgctttgttttgtgttcctatttttgatttgcgaaaggatccaagagagagaggagggggagaaggcgagaatccaagacaagagcgagcatggagtttgctacgggtgccatgggtaccctcctccccaagctgggcatgctgctgcaggaagaactccacctgaagaataatgtgaaggaggggatcaagagc

SEQ ID NO: 36153 - DNA, 632 bp, Zea mays
  misc_feature: Ceres CLONE 1419173-F
  misc_feature (284)..(284): n is a, c, t, g, unknown, or other
  misc_feature (293)..(293): n is a, c, t, g, unknown, or other
  misc_feature (331)..(331): n is a, c, t, g, unknown, or other
  misc_feature (335)..(335): n is a, c, t, g, unknown, or other
  misc_feature (342)..(342): n is a, c, t, g, unknown, or other
  misc_feature (351)..(351): n is a, c, t, g, unknown, or other
  misc_feature (353)..(353): n is a, c, t, g, unknown, or other
  misc_feature (354)..(354): n is a, c, t, g, unknown, or other
  misc_feature (357)..(357): n is a, c, t, g, unknown, or other
  misc_feature (358)..(358): n is a, c, t, g, unknown, or other
  misc_feature (365)..(365): n is a, c, t, g, unknown, or other
  misc_feature (368)..(368): n is a, c, t, g, unknown, or other
aagctggagctccccgcggtggcggccgctctagaactagtggatcccccgggctgcaggaattcgcacgagaccattacctagaacatcctaatcgaaaaatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgangcgagtagncagcgaagaacatgcaaatgcagggtcgaggaagcccngccnaacaccngggcgctcngnnggnnggcgggnccngaggccccccccccccaacccctacaagttccaaaagcggggggactggaccacgttcgggaagttactgggaaaccacggccccccttggaattgggccgcgggaaccgggccgcactgggtccaaattcctggccctccccccacccttttcggaaaaaacaggggccccgcccggggggggcccttttttttgggaccccttttcccccccccccggggggccggttcccctttggggaagggccgggggggcgcctcccc

SEQ ID NO: 36154 - DNA, 674 bp, Zea mays
  misc_feature: Ceres CLONE 1419179-F
  misc_feature: Encodes the peptide sequence at SEQ ID NO. 36155
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (583)..(583): n is a, c, t, g, unknown, or other
aaagctggagctccccgcggtggcggccgctctagaactagtggatcccccgggctgcaggaattcgcacgagaccattacctagaacatccaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtggccgccgccggttcatctgccgccgccaccatgccactaccctacttcaccggccccggctcagcctcatcccagccacaacccatgctcctgtgcaacgccgcatctcaggcccgtggccgcctgcagggaaacctgcggcgttggcagcacccccgatcctggggcnnnnccccaccggctcagttctgaggatcantggcagccccgaccggcgacgaccctactgggtcggctcaaaatgccagtcgttggccggcagccagtgttgcccagcagctttcaggcag

SEQ ID NO: 36155 - protein, 135 aa, Zea mays
  misc_feature: Ceres CLONE 1419179-F
  misc_feature (129)..(129): Xaa is any aa, unknown, or other
  misc_feature (130)..(130): Xaa is any aa, unknown, or other
MRVLLVALALLALAASATSTHTSGGCGCQPPPPVHLPPPVHLPPPVHLPPPVHLPPPVHLPPPVHLPPPVHVAAAGSSAAATMPLPYFTGPGSASSQPQPMLLCNAASQARGRLQGNLRRWQHPRSWGXXPPAQF

SEQ ID NO: 36156 - DNA, 642 bp, Zea mays
  misc_feature: Ceres CLONE 1419188-F
aaagctggagctccccgcggtggcggccgctctagaactagtggatcccccgggctgcaggaattcgcacgagaccattacctagaacatcctaatcgaaaacataataaaacacagcggagtgtagaaaatgtgcaccaggagcagtttacaaacagcggttcttttttgtgctgaaccaccagtagttgagccgtgaaggaatggaaaaactttccacttgctcatttccgagcgccttctcattcattgtatgcatgttttggactcgtggctggacgtcttgcacacaggaatccaatcactggagttgcaagatactggtatgaaaaatccagactgctgttctcgtgatattttgttcggaatgttatacaacgttgaagattttgtccgtgaatgcgctggcgttcgcgagcccgcgcgtcgggggcggcaacttcaagagggcgctggcctcgttcccggacctgcaggcgctccacgtgaaaacgccgggaacatcgcgccgacgtacgtacccgccgctggggtacgtggccgtgcagctgcctatcgccacgggggaacggggcggtcgccgcacctgcggcagcccgggacgatcgcgacgctgcagagcctcgggcgttggggacatgg

SEQ ID NO: 36157 - DNA, 719 bp, Zea mays
  misc_feature: Ceres CLONE 1419193-F
  misc_feature: Encodes the peptide sequence at SEQ ID NO. 36158
  misc_feature (388)..(388): n is a, c, t, g, unknown, or other
  misc_feature (389)..(389): n is a, c, t, g, unknown, or other
  misc_feature (406)..(406): n is a, c, t, g, unknown, or other
  misc_feature (410)..(410): n is a, c, t, g, unknown, or other
  misc_feature (416)..(416): n is a, c, t, g, unknown, or other
  misc_feature (669)..(669): n is a, c, t, g, unknown, or other
aagctggagctccccgcggtggcggccgctctagaactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtggggagaacgaaagcnnccccccaaagaggaggnaggnaggaancccgtgaaccaggctaggcgcagcagcatgggcgccgggatcagggtcctggcggcgctcttggcggcgctcgcggcagccaccgccggcgtgacggcgcagctgcggcaggactactacgcggcggtgtgcccggacctggagagcatcgtgcgcgccgcggtgtccaagaaggtgcaggcgcagcccgtcgccgtgggcgccaccatccgcctcttcttcacgactgcttcgtcagggctgcgacgcgtcngtgatcctggtgtccacggggaacaacacgcggaagaggaccacccgagc

SEQ ID NO: 36158 - protein, 92 aa, Zea mays
  misc_feature: Ceres CLONE 1419193-F
  misc_feature: SWISSPROT Homolog: EC 1.11.1.7 Peroxidase
  misc_feature (76)..(76): Xaa is any aa, unknown, or other
MGAGIRVLAALLAALAAATAGVTAQLRQDYYAAVCPDLESIVRAAVSKKVQAQPVAVGATIRLFFTTASSGLRRVXDPGVHGEQHAEEDHPS

SEQ ID NO: 36159 - DNA, 702 bp, Zea mays
  misc_feature: Ceres CLONE 1419225-F
  misc_feature: Translation starting site: 295
  misc_feature: SWISSPROT Homolog: EC 2.5.1.47 Cysteine synthase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (385)..(385): n is a, c, t, g, unknown, or other
  misc_feature (392)..(392): n is a, c, t, g, unknown, or other
  misc_feature (393)..(393): n is a, c, t, g, unknown, or other
  misc_feature (460)..(460): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggagctccccgcggtggcggccgctctagaactagtggatcccccgggctgcaggaattcgcacgagaccattacctagaacatcctaatcgaaaaatctccagcggcttcttccaaagctccaactccgacgagaaccgccactcctcgaaatctcgaaggattttctgcggcgaaccccttcgtgacgtgacccaatggggagagcctcgccgtcgatcgccaaggacgtcaccgagttgatcgggaacacgccgctggtgtaccctcacaaggtgaccgatgggntgcgtcnngcgcgtcgccgccaagctcgagtccatggagcccctgctcaacgtcaaggaataggattggctacangcatgatccccggaccccaaggaaaaagggctgaataactccaggcctggatgttcctgatttgaaccaactatacggcaaaccaggcattgggaatgggcctttaaggcgtgctaccaagggggtacaaaactttacctcccaaaagggcggggccccctgagccctggggaagagagagtccatttttgaaggggtttttgggggggaaaaaattttcccttatagaaacgccccttttt

SEQ ID NO: 36160 - DNA, 655 bp, Zea mays
  misc_feature: Ceres CLONE 1419249-F
  misc_feature: Translation starting site: 237
atagctggagctccccgcggtggcggccgctctagaactagtggatcccccgggctgcaggaattcgcacgagaccattacctagaacatcctaatcgaaaaacagcgccaagggcaccaccagcaaggaccaagacagagcacagcgcagctcgtcggcctctcgacgccggttgctgcaaccaccgcctttattgcccacgcgggccgtgcggaagaagcaagaagacacgccaatggaggtcgccgcagcatcggcagcgggctacggattcaaggccgacgacgacgttgacagcctcagggcgacggagctcaggcttggcctgccgggcacggaggaggaggaggccgaggagtcccagaacaaggcgccgccgccgccgccgtcgacgcccagaggcaagaagcgcgacgtcgtcgccagcagcgggccccgaggatgcgcccaagaagcgcgactgcgagaccgacaccgatgccgcgccgccgccggccgccaaggctcagctggtgggatggccgcccgtgaggtcgtacaggaagagctgctttcagcagcaagcggcgggccagaaacagcccgccgcagcgctggccgaagaagccccggcccgccgcgggctgttcgtgaaggtgagcatggaccgcgccc

SEQ ID NO: 36161 - DNA, 768 bp, Zea mays
  misc_feature: Ceres CLONE 1419263-F
  misc_feature: Encodes the peptide sequence at SEQ ID NO. 36162
  misc_feature (1)..(1): n is a, c, t, g, unknown, or other
  misc_feature (2)..(2): n is a, c, t, g, unknown, or other
  misc_feature (53)..(53): n is a, c, t, g, unknown, or other
  misc_feature (67)..(67): n is a, c, t, g, unknown, or other
  misc_feature (580)..(580): n is a, c, t, g, unknown, or other
nntttcgtctgttgtgtttggcgggggccggcgggtgggggggtatgctggtngggggggggggggnttgccccccgcgaaaaatgggactccccgcggtggcggccgctctataatagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagccgcagcagggaggaggcgggcgcccgatgggtgagcaggtgaagggcatgctccacgacaaggggccgacggcgtcgcacgcgctgacggtggtgacgctgttcccgctgggcgggctgctgctggtgctgtcggggctggcccttacggacctccgggttgggggctggccagggccacccccgtggttctggactttggggccgggggttgtcccccccccatgggcctatccngagaggcccctcgggggggtcccaccttcttgggggcccctggggcctggggggggttagatattctatgtggtttctgccaacggattggctgggggggggtgttccggtcttctcccgcttcttttttggagacggacgttcctccctcgtatgctcccgcggatttgggctcgccttaacggttt

SEQ ID NO: 36162 - protein, 118 aa, Zea mays
  misc_feature: Ceres CLONE 1419263-F
MADRDRSGIYGGAHATYGQQPQQGGGGRPMGEQVKGMLHDKGPTASHALTVVTLFPLGGLLLVLSGLALTDLRVGGWPGPPPWFWTLGPGVVPPPWAYPERPLGGVPPSWGPLGPGGG

SEQ ID NO: 36163 - DNA, 597 bp, Zea mays
  misc_feature: Ceres CLONE 1419269-F
  misc_feature: Encodes the peptide sequence at SEQ ID NO. 36164
aaagctggagctccccgcggtggcggccgctctagaactagtggatcccccgggctgcaggaattcgcacgagaccattacctagaacatcctaatcaaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtttctaggactgattgcatgctcagtaccactgctacattccccaaaatcagctgctcctggcctctaaggtttaagcgcaatgatgttgttgtaagaacaatatccgaagaatgtgggccgcaagggcttcccattgatctcagaagtaaaaaggcattcattgctggagttgctgatgaaaaggctatggatgggccattgccaaagcacttgctgccgctggtgctgaaattcctgtggggaccttggtggcggcacttaacataattgaacaagtctgtagcctggaaaagttgatgattcccggagctgccaaatg

SEQ ID NO: 36164 - protein, 117 aa, Zea mays
  misc_feature: Ceres CLONE 1419269-F
  misc_feature: SWISSPROT Homolog: EC 1.3.1.9 Enoyl-[acyl-carrier-protein] reductase (NADH)
MTASAAAGVQMVAARPCISASPGILTARVSRTDCMLSTTATFPKISCSWPLRFKRNDVVVRTISEECGPQGLPIDLRSKKAFIAGVADEKAMDGPLPKHLLPLVLKFLWGPWWRHLT

SEQ ID NO: 36165 - DNA, 723 bp, Zea mays
  misc_feature: Ceres CLONE 1419280-F
  misc_feature: Encodes the peptide sequence at SEQ ID NO. 36166
  misc_feature (702)..(702): n is a, c, t, g, unknown, or other
aaaagctggagctccccgcggtggcggccgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccggggtcctcctcctcccgggctcccgcccctggggcctcctccagccgggctcctgcccccggggcctccttcgaccccttcgatgtcgataccgacccgccatcgcggcttgagctgacgcccgagcagatcgggctctgcgttgacgcgctcgcgcatttcgagtacaaggggaagcgccgggatgacttgtccgacgagttcagaaagctctcggtatcggatattagacatatgaaaacgatcagtgtagctcattatcctggtaatagagaaagaacgatattatgatgtcttaccattgacgataccagagtacagcttaaatcctcagcacggcctccaaacacgattacttcatgcagctttatnaaagctacgggaaacacagag

SEQ ID NO: 36166 - protein, 115 aa, Zea mays
  misc_feature: Ceres CLONE 1419280-F
MLMRAAAALPRRSSRPSEPGSSSSRAPAPGASSSRAPAPGASFDPFDVDTDPPSRLELTPEQIGLCVDALAHFEYKGKRRDDLSDEFRKLSVSDIRHMKTISVAHYPGNRERTIL

SEQ ID NO: 36167 - DNA, 713 bp, Zea mays
  misc_feature: Ceres CLONE 1419282-F
aaagctggagctccccgcggtggcggccgctctagaactagtggatcccccgggctgcaggaattcgcacgagaccattacctagaacatcctaatcgaaaaactcttgtaattgtctcgatctttcactctcatttctatctcccaccgtagaaatttaaagtaataaaaattatttatatataaatatatcatcttcttaaatatacatcacattaatacattattacaaatttaaattttacaaaggagtcgagaagaagaagcatatgagaaagcgtcaagtggtgttgaggagagcctcgccggaggaaccttctagaagctcgtcgacggcttcgtctctgacggtgagaggtgtgagatacggcgagtgtcagaagaaccatgcggcggcggtcggcggatacgccgtcgatggctgccgtgagttcatggcaagcacggagaggaaaggttcggtggcagcgctaacgtgcgccgcctgtggctgccaccgcagtttccatcgtagagaaatcgaaaccgaggttgtttgcgactgtaattcacctccttcgactggaaactagaccagtaaaaactagacctaggtaagagtttaattggttggtgtctttgtgtgctatatattatactataatacacggctgaaaatcttaaaaatatatattatattgttttaataccttcgtagtgtcaagggtttgtgt

SEQ ID NO: 36168 - DNA, 710 bp, Zea mays
  misc_feature: Ceres CLONE 1419292-F
  misc_feature: Encodes the peptide sequence at SEQ ID NO. 36169
  misc_feature (690)..(690): n is a, c, t, g, unknown, or other
aaagctggagctccccgcggtggcggccgctctagaactagtggatcccccgggctgcaggaattcgcacgagaccattacctagaacatcctaatcgaaaaccttttgggagacacggacgagagctctagtctgcactccgcaggcaggcaagcacgcaaagctgccggcgtcctgagatggcggcgacccttcccgttccctacgccctacggctacgcgctcctcttcccatgtcgcggcgaattccccgtaagccatcattcccctgtaacagggcatgccgcgccggcgtccgctgctccgccgcaaacaagccctcccctcctcccccgaccactccggatagcagcgagctccattgcgaagatacggagtgaggtcctctccccgttccggtcggtgcggatgttcttctacctcgcgttcatggccagcggcacgctggggggcctcatcgcgctcacgcggctcctcccggcgctgtccgggtccgactccgcgagcgcggccagcacgctcaagggcctgggcatcgacgtcgcggccgtctcgctcttcgccttcctctactcgcgcgagagcaaggccaaggacgcccaggtggccaggctcgcgagggaggagcgcctgtccaggctcaggctccggctccgcgccggcgccgccgagggcgcgggtagcaacangccgttcacgctcggcgagc

SEQ ID NO: 36169 - protein, 100 aa, Zea mays
  misc_feature: Ceres CLONE 1419292-F
  misc_feature (94)..(94): Xaa is any aa, unknown, or other
MFFYLAFMASGTLGGLIALTRLLPALSGSDSASAASTLKGLGIDVAAVSLFAFLYSRESKAKDAQVARLAREERLSRLRLRLRAGAAEGAGSNXPFTLGE

SEQ ID NO: 36170 - DNA, 630 bp, Zea mays
  misc_feature: Ceres CLONE 1419294-F
  misc_feature: Encodes the peptide sequence at SEQ ID NO. 36171
  misc_feature (287)..(287): n is a, c, t, g, unknown, or other
  misc_feature (411)..(411): n is a, c, t, g, unknown, or other
  misc_feature (450)..(450): n is a, c, t, g, unknown, or other
aaagctggagctccccgcggtggcggccgctctagaactagtggatcccccgggctgcaggaattcgcacgagaccattacctagaacatcctaatcgaaaaaacttttgtccccctccctcctccacacctctcgttctctccccctccgcctgctccctctcaggagcgcgcgcgcgcgcgcccagatctagggtttcgtccgcggcaagatgagcagcccgcatggcggtctcgacgaccagatcgagcggctcatgcagtgcaagccgctcgctgagcctgangttagagctctttgtgagaaggcaaaggagattctgatggaggaaaaagcatgtcagcctgtaaagagtcctgttactatatgcggtgatattcatgggacatttcatgatcttgctgaactcntccgaatcggtggaaggtgtccagatacgaactacttgnttatgggaaattatgttgaccggggttactactctggtgaaacggtccacttttgggtggcgtttaaaagtccaaatcccccagaggaatccccttcctcgaaggaaccctggaaagccggcagattaccccaaggggtatggggtcttttaacaaatgctttaaggaaaatttggaaaa

SEQ ID NO: 36171 - protein, 139 aa, Zea mays
  misc_feature: Ceres CLONE 1419294-F
  misc_feature: SWISSPROT Homolog: EC 3.1.3.16 Phosphoprotein phosphatase
  misc_feature (25)..(25): Xaa is any aa, unknown, or other
  misc_feature (67)..(67): Xaa is any aa, unknown, or other
  misc_feature (80)..(80): Xaa is any aa, unknown, or other
MSSPHGGLDDQIERLMQCKPLAEPXVRALCEKAKEILMEEKACQPVKSPVTICGDIHGTFHDLAELXRIGGRCPDTNYLXMGNYVDRGYYSGETVHFWVAFKSPNPPEESPSSKEPWKAGRLPQGVWGLLTNALRKIWK

SEQ ID NO: 36172 - DNA, 647 bp, Zea mays
  misc_feature: Ceres CLONE 1419305-F
  misc_feature: Encodes the peptide sequence at SEQ ID NO. 36173
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaaatcacagatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactcccagacccttctctttggtgagaaaggagttgctgtgtttggctgcaggaaccctgaggagatcccatggggttcgggtggcgctgaatatgttgttgaggctactggtgttttccctgaccaggagaaagctgcaactcacttgaagggggtggccaagaaggttgcatttctgctcctaagaaggatgcccccctggttcctggttggggtcaangaaaagggagacaagtccgacctcaacattggctctaaag

SEQ ID NO: 36173 - protein, 151 aa, Zea mays
  misc_feature: Ceres CLONE 1419305-F
  misc_feature (4)..(129): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (138)..(138): Xaa is any aa, unknown, or other
MAKIKIGINGFGRIGRLVARVALQSDDVELVAVNDPFISTDYMTYMFKYDTVHGQWKHHEVKVKDSQTLLFGEKGVAVFGCRNPEEIPWGSGGAEYVVEATGVFPDQEKAATHLKGVAKKVAFLLLRRMPPWFLVGVXEKGDKSDLNIGSK

SEQ ID NO: 36174 - DNA, 641 bp, Zea mays
  misc_feature: Ceres CLONE 1419320-F
  misc_feature: Encodes the peptide sequence at SEQ ID NO. 36175
aaagctggagctccccgcggtggcggccgctctagaactagtggatcccccgggctgcaggaattcgcacgagaccattacctagaacatcctaatcgaaaaaaaaaataaaaagagcagcggagcggagcatgctcttcattccttcactgccagtcttgcatcccgtccccgtccgcgccggccgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccccgacttccccaagccagggatcatgttccaggacatcacgacgttgctgctcgatcccaaggcgttccgtgacaccatcgacctctttgtcgagcggtacaaggaccaagggatcaccgtggttgctggcgaggtgatctccgaagagtattctttggaatatggaactgacaagatagaaatgcatgtcggagctgtacaggccaacgaccgggctcttgtagtcgatgatcttattgctaccggtggaacactatgtgcagctgtcaaacttattgaacgtgttggagcaaaggttgttgagtgtgctt

SEQ ID NO: 36175 - protein, 122 aa, Zea mays
  misc_feature: Ceres CLONE 1419320-F
  misc_feature (30)..(122): Pfam Name: Pribosyltran Pfam Description: Phosphoribosyl transferase domain
  misc_feature: SWISSPROT Homolog: EC 2.4.2.7 Adenine phosphoribosyltransferase
MASADARLAGIASSIRVIPDFPKPGIMFQDITTLLLDPKAFRDTIDLFVERYKDQGITVVAGEVISEEYSLEYGTDKIEMHVGAVQANDRALVVDDLIATGGTLCAAVKLIERVGAKVVECA

SEQ ID NO: 36176 - DNA, 644 bp, Zea mays
  misc_feature: Ceres CLONE 1419323-F
  misc_feature: Encodes the peptide sequence at SEQ ID NO. 36177
aaagctggagctccccgcggtggcggccgctctagaactagtggatcccccgggctgcaggaattcgcacgagaccattacctagaacatcctaatcgaaaagtcaacgttctcccgtccccccgagcgcagtctcgcgtggttctcccgtccccccccccgtgccgtggttctccaatcctccctcatccgctctctttctttctctctcgtggcgagtggtaacgacgtcaggtgctcaggtcttgttcaggcccttcgccggcgacgagcacacagcaaatggatacaggagttcaagttatgttcatcatcagtcttgtgctctggtgtactacaagctttgccttggatgatgctgctgctacaaggattccaaatgtgggcacattacctctgtcaatgaaagaaaatccgcaattatgccaactttgtgaggagtttgcatcagaggccctcttctatttaaatgaaaatgagacccagactgaaatcattgatacactacaccaagcttgttcaaagtttggctcttttaagctggagtgcacgaggttggtggattattatgtccctcttttcttcacaaaaattgcttcattaagccctgaagaattttgtgcatcagcaagtttttgtgggga

SEQ ID NO: 36177 - protein, 120 aa, Zea mays
  misc_feature: Ceres CLONE 1419323-F
  misc_feature (45)..(83): Pfam Name: SapB_1 Pfam Description: Saposin-like type B, region 1
MDTGVQVMFIISLVLWCTTSFALDDAAATRIPNVGTLPLSMKENPQLCQLCEEFASEALFYLNENETQTEIIDTLHQACSKFGSFKLECTRLVDYYVPLFFTKIASLSPEEFCASASFCG

SEQ ID NO: 36178 - DNA, 696 bp, Zea mays
  misc_feature: Ceres CLONE 1419329-F
  misc_feature: Translation starting site: 142
  misc_feature (422)..(422): n is a, c, t, g, unknown, or other
  misc_feature (432)..(432): n is a, c, t, g, unknown, or other
  misc_feature (467)..(467): n is a, c, t, g, unknown, or other
  misc_feature (482)..(482): n is a, c, t, g, unknown, or other
  misc_feature (567)..(567): n is a, c, t, g, unknown, or other
  misc_feature (606)..(606): n is a, c, t, g, unknown, or other
aaagctggagctccccgcggtggcggccgctctagaactagtggatcccccgggctgcaggaattcgcacgagaccattacctagaacatcctaatcgaaaaagactcggattggtccgccctccttgtgctccgccggcaatggcgtccaccgccgtcaagctcatcgacatcgcagtcaacttcacagatggcatgttcaagggcatctaccacggcaagcagtgccacgccgccgacatcccggccgtacttgcgcgcgcgtgggctgcaggcgtcgaccgcatcattgtcaccggaggctccctgaaagagtccagagaggcattgcagatcgccgagaccgacgggagactgttctgcactgtgggagtgcacccaacgagatgcggggagttcgaggagagtggagaccccgaggntcattttcangcactgctggctctagcgaaagagggttagataanggcaagtcgttgctngtggtgaatgtggttttgattatgacagacttcagttctgtccggcagatatgcaaaagaagtacttcgagaaaacatttgagtnggctgaagcagtaaaactgcccatgtttcttcacatgcntgctgctggtggaaacttctgtgaaatcatgacccgaattggcacagatccccgggtggggtacacattccttccctgactcaccgaaaa

SEQ ID NO: 36179 - DNA, 641 bp, Zea mays
  misc_feature: Ceres CLONE 1419347-F
  misc_feature: Encodes the peptide sequence at SEQ ID NO. 36180
tggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgt

SEQ ID NO: 36180 - protein, 138 aa, Zea mays
  misc_feature: Ceres CLONE 1419347-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVS

SEQ ID NO: 36181 - DNA, 633 bp, Zea mays
  misc_feature: Ceres CLONE 1419353-F
  misc_feature: Encodes the peptide sequence at SEQ ID NO. 36182
aaagctggagctccaccgcggtggcggccgctctagaactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacgacggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcttgcaaatgttggcgctgaactggctcatcaagtccctgggagagtttcgacggaaatagatgctcggttagctta

SEQ ID NO: 36182 - protein, 161 aa, Zea mays
  misc_feature: Ceres CLONE 1419353-F
  misc_feature: SWISSPROT Homolog: EC 2.2.1.2 Transaldolase
MALSIYTPTSSSLVPPSIQEVRLTSRPPKPATFSLRRPHLAARAAAGNAPTSPVREVVTELDAVAGFSEIVPDTVVFDDFERFAPTTATVSSSLLLGITGLPDTKFKSAIDTALADGECNALEKAEDRMSCYLTKALANVGAELAHQVPGRVSTEIDARLA

SEQ ID NO: 36183 - DNA, 659 bp, Zea mays
  misc_feature: Ceres CLONE 1419355-F
  misc_feature: Encodes the peptide sequence at SEQ ID NO. 36184
atagctggagctccccgcggtggcggccgctctagaactagtggatcccccgggctgcaggaattcgcacgagaccattacctagaacatcctaatcgaaaaattttttcgtctattgcctgttcatcccgcccatgcctcctcgttcttcctctccaccgccgctcgcacggatccctctcctcgctgtgggtcgcaagtaggtgccgtctctgggtgcgcatggctcggatagagtccactagcgccaccatcggcttccatgcgagcaaacctccctcctcttttagtcccccgcctgttcagcacgtccgtgcctcctcgtgcttcctctccaccgccgctcacactgatccctcttcttgctgccggtcgcgggcaggcgatggctctgggtgtgcatggctcggatgaagtccaccaggctgccatcggcttacatgcgccagatttcgaggtctgtgtgtcattttggcacaaccctctcctccttcggccaagacggcacctggacgacgatgtcacgcgtacctctgcgtcgcgcgctattgcgctgctgctcctccggccagtgcgaagactagaagacgatgccaccgtggatggcaaatgccttgatctacgcacataaactgttttgacgggaccatcccactgga

SEQ ID NO: 36184 - protein, 122 aa, Zea mays
  misc_feature: Ceres CLONE 1419355-F
MRANLPPLLVPRLFSTSVPPRASSPPPLTLIPLLAAGRGQAMALGVHGSDEVHQAAIGLHAPDFEVCVSFWHNPLLLRPRRHLDDDVTRTSASRAIALLLLRPVRRLEDDATVDGKCLDLRT

SEQ ID NO: 36185 - DNA, 653 bp, Zea mays
  misc_feature: Ceres CLONE 1419357-F
  misc_feature: Encodes the peptide sequence at SEQ ID NO. 36186
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaattgtttgtttgtttgatgagaaagcgcaaacgggagagaaaccctagctggctagctctcccgcctctctataaatcagcgcagcctgttcgtacagcgccacacaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatcctacgtcccgccgccggtccagcccgtgatcgtcgtccagggcgtcatctactggcagtcctgcaagctcaggggctacaacagcggcatggacgcgtcccctctccccaatgcgaccgcgaagctggtgtgctacngcgaacccgagagcaagtacccggttgctgaacagacgaa

SEQ ID NO: 36186 - protein, 113 aa, Zea mays
  misc_feature: Ceres CLONE 1419357-F
  misc_feature (101)..(101): Xaa is any aa, unknown, or other
MASLKDHCAVVAVVVAICFVVLAAALPSHASTAVDEPAKYKPSRAPAPSPASASSYVPPPVQPVIVVQGVIYWQSCKLRGYNSGMDASPLPNATAKLVCYXEPESKYPVAEQT

SEQ ID NO: 36187 - DNA, 692 bp, Zea mays
  misc_feature: Ceres CLONE 1419360-F
  misc_feature: Encodes the peptide sequence at SEQ ID NO. 36188
aaagctggagctccccgcggtggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaaaacccacgatcttggctgagatgggacaacaccctctgtggtccttgctcaggggctgattgctgagggtgttaagtcctggcacctgtgctaatcctggtcaaatcctcg

SEQ ID NO: 36188 - protein, 119 aa, Zea mays
  misc_feature: Ceres CLONE 1419360-F
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTHDLG

SEQ ID NO: 36189 - DNA, 717 bp, Zea mays
  misc_feature: Ceres CLONE 1419361-F
  misc_feature: Encodes the peptide sequence at SEQ ID NO. 36190
  misc_feature (1)..(1): n is a, c, t, g, unknown, or other
  misc_feature (389)..(389): n is a, c, t, g, unknown, or other
naaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgncgcgcgaggacctagtcgagcaggtgaggcacgcggccgggacggtgggcttcttctggctggtgaccacggagtgccggaagagctgatgggcggcatgctccgcggggtgcgcagttcaacgaggccccgtggaggcaagcaagcgctctactcgaaggaactcgtttcgaacctgggcttcgcctccaatttcaaccttctttaaggtgctgcggcccattggcgcaacccctctttttgcgaagggggttccaacccccccccccgggggagaacttcccgaacccccttcaagaactttatcttgggaaacccccccgccgag

SEQ ID NO: 36190 - protein, 109 aa, Zea mays
  misc_feature: Ceres CLONE 1419361-F
  misc_feature: SWISSPROT Homolog: EC 1.14.11.20 Desacetoxyvindoline 4-hydroxylase
  misc_feature (81)..(81): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTXREDLVEQVRHAAGTVGFFWLVTTECRKS

SEQ ID NO: 36191 - DNA, 645 bp, Zea mays
  misc_feature: Ceres CLONE 1419362-F
  misc_feature: Encodes the peptide sequence at SEQ ID NO. 36192
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcaaaactaacgctgtccgccgccacctctcctccggcatcgacgaggcgaaaccctagcgcccgagtccctctccctgctcccacaacccatggcggcggatatggcgtacgcgccgccgatgaaggctggcaaggccgggttcgaggctggcatgatggatccacagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccaggaagtctccctgtggagaaggtaccaacacctgggatcgctttgagatgaggattcacaagagggtgatcgatctcgtcagtacaccagacgttgtcaagcagatcacctcaatcaccattgaaccaggtgtcgaggttgaggtgactatcagtgacgcttaatatggtaggcttatcatttcaaaaggcttctagtggacaaggatatttcaattcctagtgaagacttgtgan

SEQ ID NO: 36192 - protein, 128 aa, Zea mays
  misc_feature: Ceres CLONE 1419362-F
  misc_feature (28)..(123): Pfam Name: Ribosomal_S10 Pfam Description: Ribosomal protein S10p/S20e
MAADMAYAPPMKAGKAGFEAGMMDPQHRIRITLSSKSVKNLEKVCGDLVKGAKGKELKVKGPVRMPTKVLHITTRKSPCGEGTNTWDRFEMRIHKRVIDLVSTPDVVKQITSITIEPGVEVEVTISDA

SEQ ID NO: 36193 - DNA, 746 bp, Zea mays
  misc_feature: Ceres CLONE 1419372-F
  misc_feature: Encodes the peptide sequence at SEQ ID NO. 36194
  misc_feature (285)..(285): n is a, c, t, g, unknown, or other
agctggagctcaccgcggtggcggccgctctagaactagtggatcccccgggctgcaggaattcgcacgagaccattacctagaaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggncccccgatgggtgagcaggtgaagggcatgctccacgacaaggggcccgacggcgtcgcaggcgctgacggtggtgacgcttttccccctcgccaggctgctgctgggggctgtcagggctggccctaaacgccctccgtggggggggctggccgtggccccccccgtggtttcctaatcttcaacccccgtgttcgtccccgccccgctgttcattgggaacggccgtcatggggttcccccacctcgggcccccctgggggcttggagggcctgatcctcccccaactggcttcgccaaacccggggcgggaaggggtcccggccccccccgggactacctgggaggaagccccccccgcaagattggcggaaggcccccggccctaccccggccccaaaagaaccccccagggggaggccaaggccctctccagaggaaaggggcccaaagaaagccc

SEQ ID NO: 36194 - protein, 69 aa, Zea mays
  misc_feature: Ceres CLONE 1419372-F
MADRDRSGIYGGAHATYGQQQQQGGGGPPMGEQVKGMLHDKGPDGVAGADGGDAFPPRQAAAGGCQGWP

SEQ ID NO: 36195 - DNA, 646 bp, Zea mays
  misc_feature: Ceres CLONE 1419378-F
  misc_feature: Encodes the peptide sequence at SEQ ID NO. 36196
  misc_feature (528)..(528): n is a, c, t, g, unknown, or other
  misc_feature (577)..(577): n is a, c, t, g, unknown, or other
  misc_feature (611)..(611): n is a, c, t, g, unknown, or other
atagctggagctccccgcggtggcggccgctctagaactagtggatcccccgggctgcaggaattcgcacgagaccattacctagaacatcctaatcgaaaacatttaaccaataagcattcattcattagtctcagccagtcgagctcgtcggtcgccatcgccacctctaaccgccgccgtcgccgccggcccgcagtggtgccacaaaaccggtgacccctactccccctctttcctctcccctctctcccgctctgcctctcccttcgccacttctaccctgctgagggtgtcgcctatggatctcccccgtcctccgtgtgggtgcgcagcggcggtggtgcgcctggcggcagctgatgcgcacaacaaagtgttccctagttaagtgtgccgagccggaggggatggcagtcgacgcagctttgcggctgttgtggcaaccggtgcgtcggtgcccctctggaggggtttgcgcagaggctagggcagtggagacggcggaggctacctgctttgacctgngatcctggcctttcgatgtgctggatggcatcttgggcgaaaaccttgncgatggtgacatccgtggacgccacttccccctngttgaggcgtcgcattgctatgtcttccagttcgt

SEQ ID NO: 36196 - protein, 94 aa, Zea mays
  misc_feature: Ceres CLONE 1419378-F
  misc_feature (56)..(56): Xaa is any aa, unknown, or other
  misc_feature (72)..(72): Xaa is any aa, unknown, or other
MRTTKCSLVKCAEPEGMAVDAALRLLWQPVRRCPSGGVCAEARAVETAEATCFDLXSWPFDVLDGILGENLXDGDIRGRHFPLVEASHCYVFQF

SEQ ID NO: 36197 - DNA, 716 bp, Zea mays
  misc_feature: Ceres CLONE 1419386-F
  misc_feature: Encodes the peptide sequence at SEQ ID NO. 36198
agctccccgcggtggcggccgctctataactagtggatcccccgggctgcaggttttcgcacgagaccattacctagaacatcctaatcgaaaaagactgcagagacaacagatcgatcgtcccatggcgatcggcgggtcggaggccggcgggggaggcgcggggagcatgaggagcgtgctggtgacgggcggcgcggggttcatcggcacgcacacggtgctgcgcctgctggagcagggctacgtcgtcaccgtcgtcgacaacttccacaactccgtccccgaggcgctcgaccgcgtccgcctcatcgccggccccgcgctctccacccgcctcgacttcatccgcggggacctgaggagcaccgaggacttggagaaggtgttcgctgccaggaggtacgacgccgtcatccacttcgccgggctgaaggccgtgggggagagcgtcgcgcacccggagatgtactacgagaacaacctcatcggcaccatcaacctcttacagagcatgaaggagcacggctgcaagaagctggtgttcttgtcatccgccaccgtgtacggctggccggaggtgatcccatgcgtcgaggacttccatctgcaggccgcctacccattcgggaggaccaagcttttccttgaagaatatgggggcgggactaccacctgcgcgggacaaggagtggaatattcctccttggctgccc

SEQ ID NO: 36198 - protein, 197 aa, Zea mays
  misc_feature: Ceres CLONE 1419386-F
  misc_feature (19)..(196): Pfam Name: Epimerase Pfam Description: NAD dependent epimerase/dehydratase family
  misc_feature: SWISSPROT Homolog: EC 5.1.3.2 UDP-glucose 4-epimerase
MAIGGSEAGGGGAGSMRSVLVTGGAGFIGTHTVLRLLEQGYVVTVVDNFHNSVPEALDRVRLIAGPALSTRLDFIRGDLRSTEDLEKVFAARRYDAVIHFAGLKAVGESVAHPEMYYENNLIGTINLLQSMKEHGCKKLVFLSSATVYGWPEVIPCVEDFHLQAAYPFGRTKLFLEEYGGGTTTCAGQGVEYSSLAA

SEQ ID NO: 36199 - DNA, 646 bp, Zea mays
  misc_feature: Ceres CLONE 1419391-F
  misc_feature: Encodes the peptide sequence at SEQ ID NO. 36200
  misc_feature (502)..(502): n is a, c, t, g, unknown, or other
  misc_feature (519)..(519): n is a, c, t, g, unknown, or other
  misc_feature (552)..(552): n is a, c, t, g, unknown, or other
  misc_feature (580)..(580): n is a, c, t, g, unknown, or other
atagctggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgaccgccgcgccgcagtcgacgcgaggcgctctcgggttttttgcgacngcggagccgaagcaggncgcgaccatggtggcgccatcgtccccgcaggncgttccccgggtcgcggtcgtgccccangccccaggggtcgaagacatagcgcccccgcgtccccgaagggcctcccgggttttgcgtgacgcc

SEQ ID NO: 36200 - protein, 91 aa, Zea mays
  misc_feature: Ceres CLONE 1419391-F
  misc_feature (49)..(49): Xaa is any aa, unknown, or other
  misc_feature (60)..(60): Xaa is any aa, unknown, or other
  misc_feature (69)..(69): Xaa is any aa, unknown, or other
MTYVNPDPQPLAAATADDSATQHQAAVTAAPQSTRGALGFFATAEPKQXATMVAPSSPQXVPRVAVVPXAPGVEDIAPPRPRRASRVLRDA

SEQ ID NO: 36201 - DNA, 751 bp, Zea mays
  misc_feature: Ceres CLONE 1419393-F
aaagctggagctccccgcggtggcggccgctctagaactagtggatcccccgggctgcaggaattcgcacgagaccattacctagaacatcctaatcaaaaaatccgtattaaaaaaggctagggggagggccttcgctggcttactactcctgcttactagaatctacctagtctcttcaggtgcacacaacgactccagcaatggctgccgtggagaaggaggacgagatcctcgtcggcccgggggagtaggtgctagcgttgtcggcgtgcctgtctctgcgcgtcatcttgccgctggtcctggagcgcgacgactacagtgggtcctatgagaggaagcctcctacgaggaccatgacctccacctcactaagaagtagtagcgcgatgtcgcacgcgcagcaacgaggctaggaccacacgtacctgcacgacgacgactttgttggttacatgcatgtgcacgaccaccgtatagtcgatcgacctgagcctccgtcacataggtccggtcgacgcggtacgaccctgctaccacgcgtgggagaggtggacggccatgcacctctgcatgggtcaagtcccagagatacgcggtgatgatacctgtgagccgcatccgttcataaggcctacaggttcctgcctgaggtcgccggtgctggaaggggtcccccacccagaagatggaatcgggggaatgacctgtacgccctagggaatatatccaataggcgggcaccaac

SEQ ID NO: 36202 - DNA, 717 bp, Zea mays
  misc_feature: Ceres CLONE 1419394-F
  misc_feature: Translation starting site: 138
  misc_feature: SWISSPROT Homolog: EC 1.2.4.1 Pyruvate dehydrogenase (acetyl-transferring)
  misc_feature (589)..(589): n is a, c, t, g, unknown, or other
aagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaagaatgttgccattacggtgggttctttacaagtgacaaaaggtttggctgatacgtttggagaccttcgagttctggacacccctattgcggagaactcgtttactggcatgggagttggagcgggaatgaaaagggctgaggcccgtcgttaaaggatgaacatgggattcctgctccttgctaacnaccagatctcaaataactgtggcatgcttcattacactcccgcggccagttcaaaatccacttgtgatccgtgcccccgggggtgtgggtcgtcactttgagcaaaacactcccagcgcctgaaatct

SEQ ID NO: 36203 - DNA, 663 bp, Zea mays
  misc_feature: Ceres CLONE 1419397-F
  misc_feature: Translation starting site: 164
  misc_feature: SWISSPROT Homolog: EC 4.1.2.13 Fructose-bisphosphate aldolase
atagctggagctcaccgcggtggcggccgctctagaactagtggatcccccgggctgcaggaattcgcacgagaccattacctagaacatcctaatcgaaaaattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagccggtgtgatcctcttcgaggagaccctgtaccagaagaccaaggatggcaagccttttgttgatgtcctcaaggagggaggcgtcctccctggcatccaagttgaccagggcaccattgaaggtggtggccctgataaggagaccaccacccaaggccctgaccaacctggcaagcgctggcgccaatactaagaagcccgggggccgcctttgccaagtggcgccctggttctcaaaattggcccccaagaaagcatcacagctttggcctcgaacctgaacgcctcgg

SEQ ID NO: 36204 - DNA, 644 bp, Zea mays
  misc_feature: Ceres CLONE 1419406-F
  misc_feature: Translation starting site: 201
caagctggagctcaccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggggtgcttcctgctccgcttctcgacgggcggggcaggccacgggcacccttcggcctgacgggccttgtccgtgtgggaagcccctggtgcttga

SEQ ID NO: 36205 - DNA, 735 bp, Zea mays
  misc_feature: Ceres CLONE 1419407-F
  misc_feature: Encodes the peptide sequence at SEQ ID NO. 36206
aaagctggagctccccgcggtggcggccgctctagaactagtggatcccccgggctgcaggaattcgcacgagaccattacctagaacatcctaatcaaaactacggccgccgccagcatcaagctccttgctccccgaccaaaccctacctgtacccgccgccgccgccgcagcagccatgccgcccaaattggacccctctcaggtggtggaggtcttcgtccgcgtgacgggaggcgaggtcggcgcggcgtcgtcgctggcccccaagatcggcccgctcggtctctccccgaagaagatcggtgaggacatcgccaaggagaccgccaaggactggaagggcctccgcgtcaccgtcaagctcaccgtgcagaaccggcaggccaaggtctccgtcgtcccctccgccgcggcgctcgtcatcaaggcgctcaaggaacccgagagggacaggaagaaggtcaagaacatcaagcacagcggcaacatcagcctcgacgacgtcatcgagatcgccaagaccatgcggaacaggtccatggccaaggagttggccgggaccgtcaaggagatcctggggacctgcgtcagcgtcgggtgcaccgtcgatgggaaggaccccaaggacttgcagcaggagatcgatgatggtgaggtcgagatcccctcagcttaaaggctatacaactagaaatcatcggacactattaaagtggtgttttgctccaaat

SEQ ID NO: 36206 - protein, 166 aa, Zea mays
  misc_feature: Ceres CLONE 1419407-F
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIAKTMRNRSMAKELAGTVKEILGTCVSVGCTVDGKDPKDLQQEIDDGEVEIPSA

SEQ ID NO: 36207 - DNA, 723 bp, Zea mays
  misc_feature: Ceres CLONE 1419408-F
  misc_feature: Encodes the peptide sequence at SEQ ID NO. 36208
  misc_feature (723)..(723): n is a, c, t, g, unknown, or other
aagctggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgctttttagaatgtatcttaatttattgtagaggttttatcttcactcttttgacttgagcagtgttn

SEQ ID NO: 36208 - protein, 118 aa, Zea mays; identical to SEQ ID NO: 12523
  misc_feature: Ceres CLONE 1419408-F
  misc_feature (13)..(116): Pfam Name: MAP1_LC3 Pfam Description: Microtubule associated protein 1A/1B, light chain 3

SEQ ID NO: 36209 - DNA, 705 bp, Zea mays
  misc_feature: Ceres CLONE 1419410-F
  misc_feature: Encodes the peptide sequence at SEQ ID NO. 36210
ggagctccccgcggtggcggccgctctagaactagtggatcccccgggctgcaggaattcgcacgagaccattacctagaacatcctaatcgagaaaccattccgattcggcgatttgattccctatccctgcgctgcccacctcccctttcccgcctggccctcccattcacttgcccccttttttccctctcccgacctcccaattcccgaaatcacccccgacactccccacccaagaacccctcgtccccacctcgccatgggcagcgccgccgcctcgccgccgccgtccgggaagctgacgcaggaagagctgaagcgcgtggcggcgcaccgcgcggtggagttcgtggagcccggcatgacgctgggcctgggcacgggctccacggcggcgcacgcgctggaccgcctgggcgacctcctccgcgcgggcgcgctgcggggggtggccgcgtgcccactccctcaagacggagcccacgcggcgcgcgcggggatcccgctgctcccgctcccgggcgcaagatcgcgctttccatcaaggggccccacaaaggtcacccgaacctcaacctcttaaggggcccgggggctctccttcccccaaaaaaaataaaaaggggggccggcccccctttttttttatattaaaaaaaaacaaatcttgcgccccccttggtgggcgggggcccccccccg

SEQ ID NO: 36210 - protein, 107 aa, Zea mays
  misc_feature: Ceres CLONE 1419410-F
  misc_feature: SWISSPROT Homolog: EC 5.3.1.6 Ribose-5-phosphate isomerase
MGSAAASPPPSGKLTQEELKRVAAHRAVEFVEPGMTLGLGTGSTAAHALDRLGDLLRAGALRGVAACPLPQDGAHAARAGIPLLPLPGARSRFPSRGPTKVTRTSTS

SEQ ID NO: 36211 - DNA, 631 bp, Zea mays
  misc_feature: Ceres CLONE 1419420-F
  misc_feature: Encodes the peptide sequence at SEQ ID NO. 36212
  misc_feature (470)..(470): n is a, c, t, g, unknown, or other
tggagctccccgcggtggcggccgctctagaactagtggatcccccgggctgcaggaattcgcacgagaccattacctagaacatcctaatcgaaaaagtaacaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttcccccgtgtgctgttggacggggcgcctgcgcgcgcccgacgccgcccaagggggagttccacgtcngggttcaacgggcgctcccttctacctggcccccaacgcgcaagcggggccaacggttcccgggtcttcgtcaccccgcacggttctccccttgaagggccccttgcccgccctttgggttgggcccttcaggggccgctggttcccggcacccggggggc

SEQ ID NO: 36212 - protein, 151 aa, Zea mays
  misc_feature: Ceres CLONE 1419420-F
MASPKPSSAALLLLAAAAVLALARADLTHDNCVKNKKVTVQNLCSHDVTLTLEPLANSPPLFAGTYTLHPRSHAEFPRVLLDGAPARARRRPRGSSTSGFNGRSLLPGPQRASGANGSRVFVTPHGSPLEGPLARPLGWALQGPLVPGTRG

SEQ ID NO: 36213 - DNA, 723 bp, Zea mays
  misc_feature: Ceres CLONE 1419421-F
  misc_feature: Encodes the peptide sequence at SEQ ID NO. 36214
ggagctccccgcggtggcggccgctctagaactagtggatcccccgggctgcaggaattcgcacgagaccattacctagaacatcctaaaaaaaaaaacctagctagatttagaggaaaaaaaaaactgtccccaaccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgctgacggtcgctcctcccagccccagcatgagactcaatcacatggcagtggttcctccaaatctcgagaaagggaccgagaacgtgataagggaaaggacagggagcgaggcaaagaccgtgtccgcgaaaaggagagggaccgagacagggacaaggatcgtgaaagaggtgacagagacagggatcgtgatcgccaccacatggatcgtcgcgagcgcagcgagataagggaacaccgtgatcgttctgatgatcgtgaccgtcaccgcgatgatcgtgaccgtcgcaggagtcatgattctgagaggagagagatcgtgacagagatggccatcgtaggcatcgctcccgttccccttctaagagtcgtgaccgtgaccgcagatctagatctcgttcacgctctagatcgaggacaagcgcgtgagtggttttgaccag

SEQ ID NO: 36214 - protein, 191 aa, Zea mays
  misc_feature: Ceres CLONE 1419421-F
MAEYGERYQGNGDPATPEGGYAQTEYAAAGGSPPADRKPSVFSDHADGRSSQPQHETQSHGSGSSKSRERDRERDKGKDRERGKDRVREKERDRDRDKDRERGDRDRDRDRHHMDRRERSEIREHRDRSDDRDRHRDDRDRRRSHDSERREIVTEMAIVGIAPVPLLRVVTVTADLDLVHALDRGQAREWF

SEQ ID NO: 36215 - DNA, 639 bp, Zea mays
  misc_feature: Ceres CLONE 1419426-F
  misc_feature: Encodes the peptide sequence at SEQ ID NO. 36216
  misc_feature (628)..(628): n is a, c, t, g, unknown, or other
aaagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtctttctctccgtgtcggaagcactcgggccacaggggcggacccgtgaacgacngtctttcggcg

SEQ ID NO: 36216 - protein, 35 aa, Zea mays
  misc_feature: Ceres CLONE 1419426-F
MFASRTHHLLNNVQTANHNILLHSPTSHTFQLGAA

SEQ ID NO: 36217 - DNA, 734 bp, Zea mays
  misc_feature: Ceres CLONE 1419441-F
  misc_feature: Encodes the peptide sequence at SEQ ID NO. 36218
aaagctggagctccccgcggtggcggccgctctagaactagtggatcccccgggctgcaggaattcgcacgagaccattacctagaacatcctaatcgaaaaaaaatagaaaaagtctcctgcctccgcggccgtgccgagccggcatcccctcccgtcccccacccccagcagcgatcgcgacgacccgagccggcaagggtgacaggcggctgacgagccccatgggagacaacaagtctccgctgagcctgagcccgatgggcgggcgcgaccgggaccgggagctcctcatcccggtctcgggcggcggctcggcgcccggcgacggggtcgaggacggggacagggcctcctccgcctccgccgcgctatcctcctccggccgcgaggctttccataaggttgtccgcagttgggcttcaaagaagttcatgactggatgtgtaattctcttccccatagcaataacgttctacatcacctggtggttcattcattttgttgatggattcttctctccaatctatgctcaactgggaatcaacatatttggtcttggctttgtcacatctgttactttcatatttttgatcggagtctttatgtcatcttggcttggggcatctgtccttagccttggcgagtggattattaagcgcatgcctcttgttcgtcatatctacaatgcatcgaagcaaattagtgctgcaatatcaccagagttattctgg

SEQ ID NO: 36218 - protein, 170 aa, Zea mays
  misc_feature: Ceres CLONE 1419441-F
  misc_feature (106)..(169): Pfam Name: DUF502 Pfam Description: Protein of unknown function (DUF502)
MGDNKSPLSLSPMGGRDRDRELLIPVSGGGSAPGDGVEDGDRASSASAALSSSGREAFHKVVRSWASKKFMTGCVILFPIAITFYITWWFIHFVDGFFSPIYAQLGINIFGLGFVTSVTFIFLIGVFMSSWLGASVLSLGEWIIKRMPLVRHIYNASKQISAAISPELFW

SEQ ID NO: 36219 - DNA, 598 bp, Zea mays
  misc_feature: Ceres CLONE 1419442-F
ggagtccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaactcctcccctctcctcgtgttcctctctcatcctctctgccgcttcccgctctcccaaactactctgtgcccctcagatcgacctggactttggcggcagctacttcttctcgacggggcgcacggcagcaagcagcaaggagaacgcggcggcacggggctgctgctacttctgcttcctcccccacgctttgctggttagcagttcaaagcaaaacttgaagggcttcctttccaaaccccggtaaaaaaaaaatttggggggggccctacccccaaacccaataagggccccgggtcccccctttgctgctttaggaagatgtgtacccccctaaaaaatttttgaaaagcctttgccgcaaaatttttcctttgaagaggggggggaaaatatcccaaaacttttgg

SEQ ID NO: 36220 - DNA, 732 bp, Zea mays
  misc_feature: Ceres CLONE 1419447-F
  misc_feature: Encodes the peptide sequence at SEQ ID NO. 36221
atagctggagctccccgcggtggcggccgctctagaactagtggatcccccgggctgcaggaattcgcacgagaccattacctagaacatcctaatcgaaaactctcttcttcccgcggtctgctcgttcgatctgtgcagcatatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcctgaaggatgacaaccctctttttgggtcttcccgtattgaacaagcccacgttgagcaatggatggattttgccgcaacagaagttgatcctggtgttgcatggtacttgtatccgaggcttgagtacctcccttatgttagcacgactgaggaaacagctatttcttcattgaagaggtcccttggtgctctgaacacccaccttgcttcaaacacataccttgttgggcatgctgttactccagctgactttgtaaagacttgccacctccaccatggaatttgacggatcctgacccagaccttcccgtctgt

SEQ ID NO: 36221 - protein, 171 aa, Zea mays
  misc_feature: Ceres CLONE 1419447-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGAGNKNAFKALIAAEYSGIKVELTKDFEMGVSNKTPEFLKMNPLGKVPVLETPDGPVFESNAIARYVARLKDDNPLFGSSRIEQAHVEQWMDFAATEVDPGVAWYLYPRLEYLPYVSTTEETAISSLKRSLGALNTHLASNTYLVGHAVTPADFVKTCHLHHGI

SEQ ID NO: 36222 - DNA, 752 bp, Zea mays
  misc_feature: Ceres CLONE 1419449-F
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
gggggggggnnngggggnnnnggggggggggtaggggggggggaggggggggaaactgggagtccccgcgttggcggccgctctagatatggtggatcccccgggctgcaggaattcgcacgagaccattacctagaacatcctaatcgaaaattccccatctctggataaaagataaggagtgtctctcctttgccatcctcctctctttcagctaagtccctgccccctctctttttcttacattcaggtcctcgcagctcctctcttttttcttggttctttcgatctgcgagccgtcaaagtccagtactcttctttccctcaaggaactcttgcagccggaccctctggtttcttcgaattcttgttccccggtccctcctcctgtccccgcgtagatgcgtccgtccgaggagcacaccgtccccacccgcatgtttacccaccacttcctctgaccgccgccgtgctccgaagaaggcgagtgggcaccggatccgacgctcccaattccttctccgtcgccgttcatctactgggatctacatacgtctcgaggaacacttcgccccatttcaagcaggggaatactacaaccgtttcttccctcctctcataccaccctagagaaaagacgatccgaaacccctccccaaagggctaccagcatacacacccaagacagtaactggaacaccataccagagacgaaaatgtgatgtgcagcgcgggcaggggaagcacatcca

SEQ ID NO: 36223 - DNA, 644 bp, Zea mays
  misc_feature: Ceres CLONE 1419450-F
  misc_feature: Translation starting site: 292
  misc_feature (360)..(360): n is a, c, t, g, unknown, or other
  misc_feature (448)..(448): n is a, c, t, g, unknown, or other
  misc_feature (570)..(570): n is a, c, t, g, unknown, or other
ggagctccccgcggtggcggccgctctagaactagtggatcccccgggctgcaggaattcgcacgagaccattacctagaacatcctaatcgaaaaaagaagcacttctccaggttgaaaagatatgcaaggttgccaacaaaccgctggttgttacctacacaggactcattcagacttgcatagacaatggtggcatggaagatgctaaatacatattcaaccacatgtgcaactactgttcacctaattctgttacttgcaacatcatgatgaagtcatatattaaacatggaaatgcttgaagacgcgaaagacctgctccatgatattctgaattgcaggataaggagtaaagcngattcctatcaggtggcagccgctgacaagtttacttttcatactttcatggaggcctgtgctgcaccaaaaaggtgaaatgacttcnagtatgcgtttccggaaatgttatttgatgggttaccatttccatgagcgaaagaccccttcggatggtacctggacccttttaggcatgggaaaggaaaccccttgttgaaataacttatnggcactaccctggggccgtccaagccggtgtccccccccttccccttgtaaaaaggaaaaaattttctcccaaa

SEQ ID NO: 36224 - DNA, 636 bp, Zea mays
  misc_feature: Ceres CLONE 1419452-F
  misc_feature: Encodes the peptide sequence at SEQ ID NO. 36225
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaagtcgccttcgtcgtcgccttggccgcgctggtgctcaccctggcgcacacgcacgagcgcaggtccatgctcgtcggca

SEQ ID NO: 36225 - protein, 135 aa, Zea mays
  misc_feature: Ceres CLONE 1419452-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVG

SEQ ID NO: 36226 - DNA, 635 bp, Zea mays
  misc_feature: Ceres CLONE 1419454-F
  misc_feature: Encodes the peptide sequence at SEQ ID NO. 36227
ctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggcccccgtggaggcgaagcaggcgctctactcgagggacctcgctcgcaaactgcgcttcgcctccaatttcgacctcttcaaggctgctgcgggcgactgccgcaacacgctcttctgcgaaggggc

SEQ ID NO: 36227 - protein, 166 aa, Zea mays
  misc_feature: Ceres CLONE 1419454-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPRGGEAGALLEGPRSQTALRLQFRPLQGCCGRLPQHALLRRG

SEQ ID NO: 36228 - DNA, 644 bp, Zea mays
  misc_feature: Ceres CLONE 1419456-F
  misc_feature: Encodes the peptide sequence at SEQ ID NO. 36229
  misc_feature (259)..(259): n is a, c, t, g, unknown, or other
aaagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggnagccggcaagccactgtcgatcgaggaagtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagaaggtgtgactgacgtagctccgggcgaacatgtccttcctggtgtcactggggagtgcaaggagtgtgcccactgcaagtcgcagagagcaactggtgtgatctgctcaggatcaaccccaccccggtgtgatgattgccatgggaagtcccgttttcaacaatggggaagccatctccactttgtggggaccccc

SEQ ID NO: 36229 - protein, 145 aa, Zea mays
  misc_feature: Ceres CLONE 1419456-F
  misc_feature (34)..(123): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (17)..(17): Xaa is any aa, unknown, or other
MATAGKVIKCKAAVAWXAGKPLSIEEVEVAPPQAMEVRVKILFTSLCHTDVYFWEAKGQTPVFPRIFGHEAGGIIESVGEGVTDVAPGEHVLPGVTGECKECAHCKSQRATGVICSGSTPPRCDDCHGKSRFQQWGSHLHFVGTP

SEQ ID NO: 36230 - DNA, 587 bp, Zea mays
  misc_feature: Ceres CLONE 1419460-F
  misc_feature: Encodes the peptide sequence at SEQ ID NO. 36231
aaagctggagctccccgcggtggcggccgctctagaactagtggatcccccgggctgcaggaattcgcacgagaccattacctagaacatcctaatcgaaaaagccgtggatcgagtgcggagggggagaagcgtctatcccatgtcccgcgacggcggggaatagggcgacagctgcggcggggatcggctgcggcggctcgacgaggcggcggcggcggcgcgggtgggcggcggcaccatgtctgcggtagtctgtggcaagaggtcctcctccatcttcaccgacgagctcctcccgccatcccctacctcccctcactcctcccaccagccggcgcccaagaggtcccgccggtccccctcgcaccgcggcagctccgacggacaccgacgggaggcgctcgtccaccatctgcttttactcttcccccgaactggatcccccagttggcttaaaaaaaccctctgggaaccccccgggggaaagagccttgggatttccgaaaaaaaatgttgatttttccccccttgaggccccgaagggttctttgggccccccggggttcaaacccgaaaaggggggt

SEQ ID NO: 36231 - protein, 92 aa, Zea mays
  misc_feature: Ceres CLONE 1419460-F
MSAVVCGKRSSSIFTDELLPPSPTSPHSSHQPAPKRSRRSPSHRGSSDGHRREALVHHLLLLFPRTGSPSWLKKTLWEPPGGKSLGISEKKC

SEQ ID NO: 36232 - DNA, 612 bp, Zea mays
  misc_feature: Ceres CLONE 1419466-F
  misc_feature: Encodes the peptide sequence at SEQ ID NO. 36233
caaagctggagctccccgcggtggcggccgctctagaactagtggatcccccgggctgcaggaattcgcacgagaccattacctagaacatcctaatcgaaaacacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaggctctgcacaagaacctagctgccagagaattgctataccaacaccagcataacaaaaggatgagctgccctgccatggcacagctcctctccaataccctgtactacaagcgcttcttcccatattacgccttcaatgtgctcggtgggcttgaccaccaagggaaaaggtggtgtttttcacctttgaaagaaaaagggttcccccaaaaaaaaaaatgttttttgtaggccccag

SEQ ID NO: 36233 - protein, 142 aa, Zea mays
  misc_feature: Ceres CLONE 1419466-F
  misc_feature (10)..(142): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDHQGKRWCFSPLKEKGFPQKKKCFL

SEQ ID NO: 36234 - DNA, 646 bp, Zea mays
  misc_feature: Ceres CLONE 1419467-F
  misc_feature: Encodes the peptide sequence at SEQ ID NO. 36235
aagctggagctccccgcggtggcggccgctctagaactagtggatcccccgggctgcaggaattcgcacgagaccattacctagaacatcctaatcgaaaaaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggcccagatcaaggagcaggagggcatccctccagaacagcagcggctcatctttgctgggaaagcacttgaggacgggcgcacgcttgccgactacacatccagaggagagcaccctcacctggtgctgcgctcagggggaggatgcaaatctcgtgaa

SEQ ID NO: 36235 - protein, 156 aa, Zea mays
  misc_feature: Ceres CLONE 1419467-F
  misc_feature (6)..(74): Pfam Name: ubiquitin Pfam Description: Ubiquitin family
  misc_feature (82)..(149): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAQIKEQEGIPPEQQRLIFAGKALEDGRTLADYTSRGEHPHLVLRSGGGCKSRE

SEQ ID NO: 36236 - DNA, 560 bp, Zea mays
  misc_feature: Ceres CLONE 1419474-F
  misc_feature: Encodes the peptide sequence at SEQ ID NO. 36237
  misc_feature (134)..(134): n is a, c, t, g, unknown, or other
  misc_feature (135)..(135): n is a, c, t, g, unknown, or other
  misc_feature (137)..(137): n is a, c, t, g, unknown, or other
  misc_feature (139)..(139): n is a, c, t, g, unknown, or other
  misc_feature (227)..(227): n is a, c, t, g, unknown, or other
aagctggagctccccgcggtggcggccgctctagaactagtggatcccccgggctgcaggaattccacgagaccattacctagaacatcctaatcgaaaaaaaccgagcggacgccgccatggatcgcgagtgnngngngccctttcccccccaagcccggcagcggcggcgccgcctccgcgcagaatgaggccatcgaccggcgggagcgcctccgccgcctggncctcgagaccatcgacctcgccaaggacccctatttcatgcgcaaccacctcggcagctacgagtgccagctgtggctgacgctgcacaacaatgagggggactacctggccccacacgcaggggaagcggcacccggaacaacctcccccaagcgcgccccccccaaggccaaggaaccaccccgcgcaaaccttcagccccaaaaaggggaaagcttggcccccccccaaattttttttaaaatttggccaaacccgggttttaaagtacccccaaacattttggtcccccgaaaaagaaaaccccccccccctttttcttttttgaaaaa

SEQ ID NO: 36237 - protein, 98 aa, Zea mays
  misc_feature: Ceres CLONE 1419474-F
MRNHLGSYECQLWLTLHNNEGDYLAPHAGEAAPGTTSPKRAPPKAKEPPRANLQPQKGESLAPPQIFFKIWPNPGFKVPPNILVPRKRKPPPPFSFLK

SEQ ID NO: 36238 - DNA, 669 bp, Zea mays
  misc_feature: Ceres CLONE 1419478-F
  misc_feature: Encodes the peptide sequence at SEQ ID NO. 36239
aaagctggagctccccgcggtggcggccgctctagaactagtggatcccccgggctgcaggaattcgcacgagaccattacctagaacatcctgatcggaaaactcttctcccctctctctcttccccgccccctctgtctcgacatcggtgccgtcatcttctcggcctctcgccggttggatccatcgggcgctggtcggatctgcctttcggtcgccgttgcccctccgccacgcctcgcgccagccggtcctgctgagcgccggcctgatccgcctccctctagtcggatctgcttggcgtcggcctctcgccgctactgctccgcatcctgggcttcctcaccgatgcacgatcctggcaccacgccacgccggtgtgctaccggctccttggcggggagcggaccacatggtctgtgctcacgctgagcagggaaccacgatcgctcccgttcctcatcattaggccgaatttctacttctcgacgctggaacaacctgaactccccatgggggcgtccttccctcctcgccggccggtcgccgtttcccggtgccaggcgaagcgcgccctggtggccatgggtggggtaccggttgaaaggggccccccccccgttggctccgaatcccccggggcttggcacccgtgggagaaccggggg

SEQ ID NO: 36239 - protein, 52 aa, Zea mays
  misc_feature: Ceres CLONE 1419478-F
MGASFPPRRPVAVSRCQAKRALVAMGGVPVERGPPPVGSESPGAWHPWENRG

SEQ ID NO: 36240 - DNA, 631 bp, Zea mays
  misc_feature: Ceres CLONE 1419481-F
  misc_feature: Encodes the peptide sequence at SEQ ID NO. 36241
  misc_feature (631)..(631): n is a, c, t, g, unknown, or other
ccgcggtggcggccgctctagaactagtggatcccccgggctgcaggaattcgcacgagaccattacctagaacatccaatcgaaaaatagataagggcgacctccaggcccttgcgaaccctagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggcccgcggtgaggtgatcagcaccaagaggcagcctgtgggacccaaacctggcttcatggttgagggtgctacactcgagan

SEQ ID NO: 36241 - protein, 147 aa, Zea mays
  misc_feature: Ceres CLONE 1419481-F
  misc_feature (2)..(100): Pfam Name: Ribosomal_L21e Pfam Description: Ribosomal protein L21e
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLKADAKARGEVISTKRQPVGPKPGFMVEGATLE

SEQ ID NO: 36242 - DNA, 699 bp, Zea mays
  misc_feature: Ceres CLONE 1419486-F
  misc_feature: Translation starting site: 189
ctccccgcggtggcggccgctctagaactagtggatcccccgggctgcaggaattcgcacgagaccattacacgagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtcccgggctgatcctggccggcaccgtgatcgcgctcacggtggccaccccccgtgctggtgatctttcgccccggggctgggtgcccgcccgccatccccccttggcgctcattggcgggccgggtttcgtccccctccggcgggccttcggcgtccccttgcgcctttcccgggtctcccctggaatggacaaagtacccttaacggggcaaacaccccggcccgggccccccaaccaactctggaacccaccccccaagggcgaaggcttgggcgttccaaaggcccccccgaactttcaagggaatgcaggtaaaaagacccccgaattccaaccaagg

SEQ ID NO: 36243 - DNA, 581 bp, Zea mays
  misc_feature: Ceres CLONE 1419501-F
  misc_feature: Encodes the peptide sequence at SEQ ID NO. 36244
  misc_feature (47)..(47): n is a, c, t, g, unknown, or other
tggagctccccgcggtggcggccgctctagaactagtggatcccccngggctgcaggaattcgcacgagaccattacctagaacatcctaatcgaaaaactaaactagtgcggggtataaagctctctccctccgcgcttccgaacagttcacgacgactccaggaggggcgcacttgactttcccctcctcctcctgcgagcaccttcctcgcctcgctctcatggcctcatcagagcctatagagtgccaggttgtggcgctgagggtgtcgattcactgccaaggatgcaagaagaaggtgaagaaggtgctccagaacatcagcggcgtgtaccgatgcgaaatcgatgcccggagcaacaaggtcgtggcgacggtctcgaaggaactccaaccccctacatgcttggccccaaaatgcccaaatcccggaaacagggggaattttgcccggaacaccccggggcaacaacagggaaccccccggcccccccccccttgaagccccaaggggggggggggccccaaaaaaaaccccccccggggggggggggggggaaaccccccgaaaacctctg

SEQ ID NO: 36244 - protein, 93 aa, Zea mays
  misc_feature: Ceres CLONE 1419501-F
MASSEPIECQVVALRVSIHCQGCKKKVKKVLQNISGVYRCEIDARSNKVVATVSKELQPPTCLAPKCPNPGNRGNFARNTPGQQQGTPRPPPP

SEQ ID NO: 36245 - DNA, 659 bp, Zea mays
  misc_feature: Ceres CLONE 1419502-F
  misc_feature: Encodes the peptide sequence at SEQ ID NO. 36246
  misc_feature (577)..(577): n is a, c, t, g, unknown, or other
aagctggagctccccgcggtggcggccgctctataactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgatcttgtcccctttcacaaccaagtgtacaacggcagccttnaccagccgctgggcgtcaccgccgggcatctgcgtggtcattcaggacgtcccccgaccgcaacggcgaccgcttcgaaggc

SEQ ID NO: 36246 - protein, 138 aa, Zea mays
  misc_feature: Ceres CLONE 1419502-F
  misc_feature: SWISSPROT Homolog: EC 5.3.99.6 Allene-oxide cyclase
  misc_feature (112)..(112): Xaa is any aa, unknown, or other
MAAALRCPASVRVSGPAAAGLAKVRQASRVVAVSGARQSRSGGVAVRASLFSPKPAAAKDARPTKVQELYVYEINERDRESPAYLRLSAKQTENALGDLVPFHNQVYNGSLXQPLGVTAGHLRGHSGRPPTATATASK

SEQ ID NO: 36247 - DNA, 657 bp, Zea mays
  misc_feature: Ceres CLONE 1419503-F
  misc_feature: Encodes the peptide sequence at SEQ ID NO. 36248
  misc_feature (415)..(415): n is a, c, t, g, unknown, or other
aagctggagctccccgcggtggcggccgctctagaactagtggatcccccgggctgcaggaattcgcacgagaccattacctagaacatcctaatcgaaaaacaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcccgcgggtccgtcgatgtcaccaactcctacgccgtgccgtttgaggaggatgacaaggatcctangatctggttccttgaccacaattaccacgagtcaatgttctccatgttccagagattaatgccaaggaggatgttgttggctggtacagcactggcccaaaacttagggagaacgacttggatggtcatgcattatttcacaggtatggtcctaaacccggcctggtgattattgatgtccaaccccaggagctgggtataccgaaccaagacgacttcgcttggggaagaaggtaaagaga

SEQ ID NO: 36248 - protein, 128 aa, Zea mays
  misc_feature: Ceres CLONE 1419503-F
  misc_feature (12)..(121): Pfam Name: Mov34 Pfam Description: Mov34/MPN/PAD-1 family
  misc_feature (73)..(73): Xaa is any aa, unknown, or other
MDVVKAAQLSGRTLERVVVHPLVLLSIVDHYNRVARDTRKRVVGVLLGTSSRGSVDVTNSYAVPFEEDDKDPXIWFLDHNYHESMFSMFQRLMPRRMLLAGTALAQNLGRTTWMVMHYFTGMVLNPAW

SEQ ID NO: 36249 - DNA, 668 bp, Zea mays
  misc_feature: Ceres CLONE 1419505-F
  misc_feature (668)..(668): n is a, c, t, g, unknown, or other
aagctggagctccccgcggtggcggccgctctagaactagtggatcccccgggctgcaggaattcgcacgagaccattacctagaacatcctaatcgaaaaaatctctctcttctcctcgcctcggcttggtgttcacgccgtcgctagcgcctgccgcggcaaagcttctgccctccccggtgccaggatcgggtcgtcgtccggcatgcagctgctactcgtgaacacggtcacaccagtacggcagtaccacgcgacgtgaacggggaaatcgtgaagaacagagccaccactgagaaaaccctatcgacggcggcgtgctaccggtgacattgtccccctcgacccctcaatccctgacgcagcggcggcacgcctgcaggaagcgcagcccctattcgagacaaggtcgatctttgctgccttggcgagcttcagccgaatcaaggtcgagcatggctgcaggccagtaaatagagcaacacaaaacccttcaaattaatggagacctctgcagcaacaccgacccggtcgccacaccatgcggccacttccccatcgccatcgccctcatcgtcactgacgatgtggaggccagccgtgcaacgaaacatgcgcaatcactggtcccatctgagcgccgcccaggagcaatggctggccgcn

SEQ ID NO: 36250 - DNA, 662 bp, Zea mays
  misc_feature: Ceres CLONE 1419507-F
  misc_feature: Encodes the peptide sequence at SEQ ID NO. 36251
aaagctggagctccccgcggtggcggccgctctagaactagtggatcccccgggctgcaggaattcgcacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgccttcatc

SEQ ID NO: 36251 - protein, 120 aa, Zea mays
  misc_feature: Ceres CLONE 1419507-F
  misc_feature (16)..(120): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATGAFI

SEQ ID NO: 36252 - DNA, 681 bp, Zea mays
  misc_feature: Ceres CLONE 1419508-F
  misc_feature: Encodes the peptide sequence at SEQ ID NO. 36253
ctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaacccctccacttggtgctgcgccctaggggaggcatgcagatcttttgtcaagacctttgactgggaagacaatcaccccttggagggggagtcctcagacacccattgacaatgtcaggggcaaagatccatgacaaaggaggggcttcccaccctggcccgggaacctcttcctcttttcccggcaaacagttgggaggaaggggagggacccttgggctgacttaacactctccggaagggggaggcgcccccccctttggcgggctcggctcctaagggcgggg

SEQ ID NO: 36253 - protein, 73 aa, Zea mays
  misc_feature: Ceres CLONE 1419508-F
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTPPLGAAP

SEQ ID NO: 36254 - DNA, 634 bp, Zea mays
  misc_feature: Ceres CLONE 1419509-F
  misc_feature: Encodes the peptide sequence at SEQ ID NO. 36255
tccccgcggtggcggccgctctagaactagtggatcccccgggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcgccctcaaggactcgaagacgcttctcttcggcgagaagccggtcaccgtctttggcatcaggaacccccgaagagatcccccttggggtgaggctggtgctgagcatgccctggagcccaccggtgtcttccctgacaaggaaaaggctgctgcccatccgaaagggggggcccagaaaggttgttatctctgccccaagccaaaaagccccccatgtttgttgtttggggccaatgaggaacaagaccccccccgtgggtaacattggttt

SEQ ID NO: 36255 - protein, 148 aa, Zea mays
  misc_feature: Ceres CLONE 1419509-F
  misc_feature (4)..(147): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDIALKDSKTLLFGEKPVTVFGIRNPRRDPPWGEAGAEHALEPTGVFPDKEKAAAHPKGGAQKGCYLCPKPKSPPCLLFGANEEQDPPRG

SEQ ID NO: 36256 - DNA, 649 bp, Zea mays
  misc_feature: Ceres CLONE 1419521-F
  misc_feature: Encodes the peptide sequence at SEQ ID NO. 36257
  misc_feature (582)..(582): n is a, c, t, g, unknown, or other
  misc_feature (607)..(607): n is a, c, t, g, unknown, or other
aagctggagctccccgcggtggcggccgctctagatctagtggatcccccgggctgcaggaattcgcacgagaccattacctagaacatcctaatcgaaaactctcttcgctcagctcccacaagaaagggcgaagaatctctccctcctccttgaccttctcttcgccatcgattccctttgaggtgcaaaaatggttgaacagactcagcaacaaccctcgattctccagaaggcttcttctggccagctcatgcgctccggggtttctcaggacatccatggctacgcatctggtttccagaggcgtgcgacctacggaaactactcgaacgctgcgtttcagtaccctctcgcggcctcttccaggattgtggcgactactactacttctcctgtttttgtgcaagctccaagtgagaaaggattctctagcttcgctattgatttcttgatgggtggtgtttccgctgctgtctctaagaccgcggctgctcccattgagcgtgtggagcttttgattcagaaccaggatgagatgcttaaggctggtaagttatctgagccttacaagggtatggntgattgttttggaaggactattaangatggaggggttggttctttggtgagaagaaacactgctaac

SEQ ID NO: 36257 - protein, 152 aa, Zea mays
  misc_feature: Ceres CLONE 1419521-F
  misc_feature (130)..(130): Xaa is any aa, unknown, or other
  misc_feature (138)..(138): Xaa is any aa, unknown, or other
MVEQTQQQPSILQKASSGQLMRSGVSQDIHGYASGFQRRATYGNYSNAAFQYPLAASSRIVATTTTSPVFVQAPSEKGFSSFAIDFLMGGVSAAVSKTAAAPIERVELLIQNQDEMLKAGKLSEPYKGMXDCFGRTIXDGGVGSLVRRNTAN

SEQ ID NO: 36258 - DNA, 650 bp, Zea mays
  misc_feature: Ceres CLONE 1419525-F
  misc_feature: Encodes the peptide sequence at SEQ ID NO. 36259
atagctggagctccccgcggtggcggccgctctagaactagtggatcccccgggctgcaggaattcgcacgagaccattacctagaacatcctaatcgaaaaatcctctcgctcgccaggagaagcagccgccgttgctgctgccgcgtccacagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtctttgagttggtctgaccaactatgcagctgcctactgcactggacttctgttggctcgccgtgtgctaaagatccgtgggtttgcataaggagtatgagggcaatgttgaggccactggtgaggacttctctgttgacccagcttatgaaaagaggccattcccgtgttctcttgggatgttggccttatcaggaactcaaacagggaacccgtgtcttttggtggccc

SEQ ID NO: 36259 - protein, 89 aa, Zea mays
  misc_feature: Ceres CLONE 1419525-F
  misc_feature (27)..(90): Pfam Name: Ribosomal_L18p Pfam Description: Ribosomal L18p/L5e family
MGGFVKTHKTNAYFKRFQVKFKRRRAGKTDYRARIRLINQDKNKYNTPKYRFVVRFTNKDITAQIISASIAGDMVLASAYSHELPRYGL

SEQ ID NO: 36260 - DNA, 732 bp, Zea mays
  misc_feature: Ceres CLONE 1419527-F
  misc_feature: Encodes the peptide sequence at SEQ ID NO. 36261
  misc_feature (143)..(143): n is a, c, t, g, unknown, or other
aaactggagctccccgcggtggcggccgctctagaactagtggatcccccgggctgcaggaattcgcacgagaccattacctagaacatcctaatcgaaaaacatcgacccagccatctcctcaccctcgttcaccacacagntccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtacggtcgcggcagcgagagcgcgggcaagtgcccgggagaagtgcgagcgccaccaccgcggggactggtgggagaggcagcgctgctgagatggaaaaaaagggggggggggcggggaggagaggg

SEQ ID NO: 36261 - protein, 172 aa, Zea mays
  misc_feature: Ceres CLONE 1419527-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYGRGSESAGKCPGEVRAPPPRGLVGEAALLRWKKRGGGRGGE

SEQ ID NO: 36262 - DNA, 511 bp, Zea mays
  misc_feature: Ceres CLONE 1419528-F
  misc_feature: Encodes the peptide sequence at SEQ ID NO. 36263
  misc_feature (337)..(337): n is a, c, t, g, unknown, or other
  misc_feature (355)..(355): n is a, c, t, g, unknown, or other
  misc_feature (378)..(378): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaagggggccgacngcgtcgcaggcgctgacngtggtgacgctgttcccgctggnccggctgctgctggtgctgtcggggctggcgctgaccgccctccctggggggggtgggccgtgccaccccccgtgttcctgaactttagccccgtgttcttccccgccccgctggttaatggggaaggccgtg

SEQ ID NO: 36263 - protein, 102 aa, Zea mays
  misc_feature: Ceres CLONE 1419528-F
  misc_feature (45)..(45): Xaa is any aa, unknown, or other
  misc_feature (51)..(51): Xaa is any aa, unknown, or other
MADRDRSGIYGGAHATYGQQQQQGGGGRPMGEQVKGMLHDKGADXVAGADXGDAVPAGPAAAGAVGAGADRPPWGGWAVPPPVFLNFSPVFFPAPLVNGEGR

SEQ ID NO: 36264 - DNA, 676 bp, Zea mays
  misc_feature: Ceres CLONE 1419529-F
  misc_feature: Encodes the peptide sequence at SEQ ID NO. 36265
aaagctggagctccccgcggtggcggccgctctagaactagtggatcccccgggctgcaggaattcgcacgagaccattacctagaacatcctaatcgaaaatatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggcccgcatcgcgctggcgctcatgccggccgggttcgtcacctcccgcggccttcgggtcccttgcctgtccgtgttctccggaagtgacaagtccttgaaggggaaaccccccccggggcccaaccagttgaacccgcccatggcgaggctggggtccaaaggcccccccaatcaaggatccggccaaagccccctttcacacaagggaaggggtttttagaaaaaaaa

SEQ ID NO: 36265 - protein, 157 aa, Zea mays
  misc_feature: Ceres CLONE 1419529-F
  misc_feature (36)..(149): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPVLVPARIALALMPAGFVTSRGLRVPCLSVFSGSDKSLKGKPPPGPNQLNPPMARLGSKGPPNQGSGQSPLSHKGRGF

SEQ ID NO: 36266 - DNA, 708 bp, Zea mays
  misc_feature: Ceres CLONE 1419530-F
  misc_feature: Encodes the peptide sequence at SEQ ID NO. 36267
aagctggagctccccgcggtggcggccgctctagaactagtggatcccccgggctgcaggaattcgcacgagaccattacctagaacatcctaatcgaaaaattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccccaaatggtatgcacggctgcaccctagggctgtcaattgccgcaagaagaagtgtggttcccagcaaacccgctgagggcccaaaaaaaaaaatcaaaaactggaggggttgcctgccctagccagttccatggaacaatggtttttttgggtttttttaaacccgtgtttttgtgttacaaaacggggatttttttttttgggggggtggtgaaaccccgggggtttgtttttttcccgaaaaatag

SEQ ID NO: 36267 - protein, 121 aa, Zea mays
  misc_feature: Ceres CLONE 1419530-F
  misc_feature (6)..(74): Pfam Name: ubiquitin Pfam Description: Ubiquitin family
  misc_feature (77)..(121): Pfam Name: Ribosomal_L40e Pfam Description: Ribosomal L40e family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICPKWYARLHPRAVNCRKKKCGSQQTR

SEQ ID NO: 36268 - DNA, 513 bp, Zea mays
  misc_feature: Ceres CLONE 1419534-F
  misc_feature (192)..(192): n is a, c, t, g, unknown, or other
  misc_feature (305)..(305): n is a, c, t, g, unknown, or other
aaactggagctccccgcggtggcggccgctctagaactagtggatcccccgggctgcaggaattcgcacgagaccattacctagaacatcctaatcgaaaaaaaccctagtctcagagcagccgcatccacaacctgcctctctcgtcccctggcggcgtccgcggcaggatggcggaatctacggcgaagngaacggggtgaaggatgtcaacccgcacgagttcgtcaaggcctactccgcccacctcaagcgctccggcaagatggaggctcctgagggggttgacattgtgaagacctggnccccaagggttcaaggaagcttccccctttaaaccccgacggggacaacaccagggcgggcccccttgggagggaaaattccccctaggggaggggcccccgggggggggggggggttttttaaaaaaaaaaatttccggggggccccccaaaaaaaaaaaggtccccccccccccccccaaattttttttagaaaaagaaggggggg

SEQ ID NO: 36269 - DNA, 630 bp, Zea mays
  misc_feature: Ceres CLONE 1419535-F
  misc_feature: Encodes the peptide sequence at SEQ ID NO. 36270
  misc_feature (610)..(610): n is a, c, t, g, unknown, or other
ctccccgcggtggcggccgctctagaactagtggatcccccgggctgcaggaattcgcacgagaccattacctagaacatcctaatcgaaaaaagtcaagtcggagcccgcaggtgtcgacaccgcgcgccgggagccggaagaagggtggggggtgagctgtggaccatgagcgcgaccgggcgagccccgtgcggcctgccgcgcatcggcctgggcacggcggtgcagggcccgcggccggaccccgtccgcgccgcggtgctgcgcgccatccagctcggctaccgccacttcgacacggccgcgcactacgccaccgaggcgcccatcggggaggccgccgccgaggccgtgcgcacggggctcgtcgcctcccgcgaggacctcttcgtcacgtccaaggtctggtgcgccgacgcgcaccgggacagggtgctccccgcccctccgccggacgctcagcaatctcccaaatggaaaaacgttggacctggtactggggggcccgggccccggaacccataaaaaggcccgggagggggttaaagggcccccctttttttcccccggaaaaaattttttttgcggcctttttttaaaattttgnggcccctccctgtgggggag

SEQ ID NO: 36270 - protein, 119 aa, Zea mays
  misc_feature: Ceres CLONE 1419535-F
  misc_feature: SWISSPROT Homolog: EC 2.3.1.170 6'-deoxychalcone synthase
MSATGRAPCGLPRIGLGTAVQGPRPDPVRAAVLRAIQLGYRHFDTAAHYATEAPIGEAAAEAVRTGLVASREDLFVTSKVWCADAHRDRVLPAPPPDAQQSPKWKNVGPGTGGPGPRNP

SEQ ID NO: 36271 - DNA, 646 bp, Zea mays
  misc_feature: Ceres CLONE 1419567-F
  misc_feature: Encodes the peptide sequence at SEQ ID NO. 36272
  misc_feature (576)..(576): n is a, c, t, g, unknown, or other
  misc_feature (597)..(597): n is a, c, t, g, unknown, or other
ggagctccccgcggtggcggccgctctagaactagtggatcccccgggctgcaggaattcgcacgagaccattacctagaacatcctaatcgaaaagacgacactgcacacctctcaccagtccccacacggccacaccacacccagctgtccccatcgcgcgcacactctctcggtctctccctcccagtcccagcgtttgcggtccagtccagagagctcgagcagccatggcggctcccctgttcctcctcctcctgctgctggctatgttcacaggctcagcagacgcggcgttctgcgtgtgcaagacgggcgtgcccgaccaggcgatgcaggcggcgatcgactacgcctgcgccaagggggccgactgcgcctccgcctccaagggcgcgccctgctacggcaacggcaacaaggtggccgtctgctcctacatctgcaacagctactaccagagccgcagcgccacgggcgccacctgcgacttcaacggcgtcgccacgctcaccggcaccgaacccagcttcggcacctggcagttcgccctcggccccagcagcgcaggcaccnggcgtggcatgggcgctggcncgggtaccggcggtggcatgggcgctggcaccggcggccgggacaggct

SEQ ID NO: 36272 - protein, 138 aa, Zea mays
  misc_feature: Ceres CLONE 1419567-F
  misc_feature (22)..(106): Pfam Name: X8 Pfam Description: X8 domain
  misc_feature: SWISSPROT Homolog: EC 3.2.1.39 Glucan endo-1,3-beta-D-glucosidase
  misc_feature (116)..(116): Xaa is any aa, unknown, or other
  misc_feature (123)..(123): Xaa is any aa, unknown, or other
MAAPLFLLLLLLAMFTGSADAAFCVCKTGVPDQAMQAAIDYACAKGADCASASKGAPCYGNGNKVAVCSYICNSYYQSRSATGATCDFNGVATLTGTEPSFGTWQFALGPSSAGTXRGMGAGXGTGGGMGAGTGGRDR

SEQ ID NO: 36273 - DNA, 767 bp, Zea mays
  misc_feature: Ceres CLONE 1419587-F
  misc_feature: Translation starting site: 232
  misc_feature (5)..(5): n is a, c, t, g, unknown, or other
  misc_feature (23)..(23): n is a, c, t, g, unknown, or other
  misc_feature (25)..(25): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (767)..(767): n is a, c, t, g, unknown, or other
ggggncccccccccccccccccnanccntnnnnnnnnnngggtggcggctgctcgaactacttcgcaccacgggggggggcggtctatactagtggatcccccgggctgcaggaattcgcacgagaccattacctagaacatcctaatcaaaactacggccgccgccagcatcaagctccttgctccccgaccaaaccctacctgtacccgccgccgccgccgcagcagccatgccgcccaaattggacccctctcaggtggtggaggtcttcgtccgcgtgacgggaggcgaggtcggcgcggcgtcgtcgctggcccccaagatcggcccgctcggtctctccccgaagaagattcggtgaggacatcgccaaggagaccgccaaggactggaagggcctccgcgtcaccgtcaagctcaccgtgcagaaccggcaggccaaggtctccgttcgtcccctccgccgcggcgctcgtcataaaggcgctcaaggaacccgaagagggacaggaagaagggccaagaacctcctagcacagcgggtaacattcagcctcccacgacgtcatcgattattctcccaagaccaatgcggaaacaggtctcatggcccaacggagttgggccgggggacccgttaagggagaatcctggggggacccggcgctccaggtgtcagggggcgaccgttcctaatgggaaagggaactcccataggatccttgtcaagccagggaaaaaccgcaaggcattgcctcaacggtn

SEQ ID NO: 36274 - DNA, 680 bp, Zea mays
  misc_feature: Ceres CLONE 1419589-F
  misc_feature: Encodes the peptide sequence at SEQ ID NO. 36275
ctccccgcggtggcggccgctctagtactagtggatcccccgggctgcaggaattcgcacgagaccattacctagaacatcctaatcgaaaaattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaagccatgacgaccttggcaagcgctgcgccaagtactacgaggccggtgcccgctttgccaagtggcgcgctgttctcaagaatggcccccaatggagccatcacagctttggccatcgaacctgaacgcttcaggggctgggctcgcttatgccaatcatctg

SEQ ID NO: 36275 - protein, 162 aa, Zea mays
  misc_feature: Ceres CLONE 1419589-F
  misc_feature (11)..(161): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQSHDDLGKRCAKYYEAGARFAKWRAVLKNGPQWSHHSFGHRT

SEQ ID NO: 36276 - DNA, 607 bp, Zea mays
  misc_feature: Ceres CLONE 1419623-F
  misc_feature: Encodes the peptide sequence at SEQ ID NO. 36277
ggatcccccgggctgcaggaattcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcgccaagctcggcggatcctccgccttcgtcggcaagttcggcgacgacgagttcgggcacatgttggtgaacatcctgaagcagaacaacgtgaacgcggaggggtgcctgttcgacaagcacgcgcggacggcgctggccttcgtgaccctcaagcacgacggggagccggagttcatgttctacaggaacccgagcgcggacttgctgctgacggaggcggagcttgacctgggcctggtgcggcgcccca

SEQ ID NO: 36277 - protein, 143 aa, Zea mays
  misc_feature: Ceres CLONE 1419623-F
  misc_feature: SWISSPROT Homolog: EC 2.7.1.4 Fructokinase
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEPEFMFYRNPSADLLLTEAELDLGLVRRP

SEQ ID NO: 36278 - DNA, 697 bp, Zea mays
  misc_feature: Ceres CLONE 1419626-F
  misc_feature: Encodes the peptide sequence at SEQ ID NO. 36279
  misc_feature (352)..(352): n is a, c, t, g, unknown, or other
cggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcacccgatgggtgagcaggtgaagggcatgctccacgacaaggggccgacggcgtcgcaggcgctgacggtggcgacgctgttcccgcntggcgggctgctgctggtgctgtcggggctggcgctgacggcctccgtggtggggctggccgtggccacgccggtgttcctgatcttcagccccgtgctggtccccgccgcgctgctcatcgggacggccgtcatggggttcctcaccttcggcccgcctggggctcgggggcctgtcctcgctacagtgcctcgcccacacggccgcggcaggggtttccaccgccacccggaactacgtggaaagaggcccccccgcaagaatggccggaagcccccgggccccccccgggccccaaaaaaccccccccagggcagggccaggcccattcccgaggggaaggg

SEQ ID NO: 36279 - protein, 171 aa, Zea mays
  misc_feature: Ceres CLONE 1419626-F
  misc_feature (44)..(156): Pfam Name: Oleosin Pfam Description: Oleosin
  misc_feature (57)..(57): Xaa is any aa, unknown, or other
MADRDRSGIYGGAHATYGQQQQQGGGGHPMGEQVKGMLHDKGPTASQALTVATLFPXGGLLLVLSGLALTASVVGLAVATPVFLIFSPVLVPAALLIGTAVMGFLTFGPPGARGPVLATVPRPHGRGRGFHRHPELRGKRPPRKNGRKPPGPPRAPKNPPQGRARPIPEGK

SEQ ID NO: 36280 - DNA, 732 bp, Zea mays
  misc_feature: Ceres CLONE 1419627-F
  misc_feature: Encodes the peptide sequence at SEQ ID NO. 36281
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nggcccccccccccccccnnncnnnnnnnnnnnnggnggnnnnntnnnnnnnnccaagctgggactccccgcggtggcggccgctctagaactagtggatcccccgggctgcaggaattcgcacgagaccattacctagaacatcctaatcgaaaaacagcgcggctgcctgtaaccactccaggtctccagcgaagcaggctcaggcgcaacgcaacaacacaaggcggcggttatggcctctgctgctgcgacggctacgatggggacggggaaggtggtttgcgtcaccggcgcatcagggtacatcgcgtcctggattgtcaggctcctactcgaccgcggctacaccgtccgcgccaccgtgcgagacaccgctgacccaaagaaaacattgcacctgactgcgttggatggtgctaaggataggctgcccttatttaaagctagcctgctagaagagggttcttttcgatgctgcagttcatggatgcgacactgtatttccatactgccctctcccttttatcacaatgtcaagggatgctaaaggagaagttcttggaccccagcagtttaaggggaaccccttcaaggtttctcgggttcctgggcaaaaaaaagccttttttatttaaaaaaaggggggggttggttaacccattcctcccttagggggctgtgcctggtaaaacccccaaaacaaataagggggggagggctcacaaaggg

SEQ ID NO: 36281 - protein, 104 aa, Zea mays
  misc_feature: Ceres CLONE 1419627-F
  misc_feature: SWISSPROT Homolog: EC 1.1.1.219 Dihydrokaempferol 4-reductase
MASAAATATMGTGKVVCVTGASGYIASWIVRLLLDRGYTVRATVRDTADPKKTLHLTALDGAKDRLPLFKASLLEEGSFRCCSSWMRHCISILPSPFYHNVKGC

SEQ ID NO: 36282 - DNA, 699 bp, Zea mays
  misc_feature: Ceres CLONE 1419639-F
  misc_feature: Translation starting site: 477
  misc_feature: SWISSPROT Homolog: EC 1.1.1.1 Alcohol dehydrogenase
  misc_feature (699)..(699): n is a, c, t, g, unknown, or other
ggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagctcggtctggagaggaagggtgtcatgcacagcgatcagaaan

SEQ ID NO: 36283 - DNA, 661 bp, Zea mays
  misc_feature: Ceres CLONE 1419641-F
ctccccgcggtggcggccgctctagaactagtggatcccccgggctgcaggaattcgcacgagaccattacctagaacatcctaatcgaaaaatccatcgtcaatgcaagtttgtccattcccattggtctgaatactgtagctactaactggagtgctactgtgccgcagctgcctgctcaccattactgcaagctgtgttcgatcaaagcttaattaccgctccctctacatctgatccagctaagtagctagacagcactacagaagggcgtggcaagaatcaggatagagatagcaggggggctagctagctgagctcatgcgaccaacaatggacagaattggcaggaacatggaggcgccgctcctggcgctcaacctcatcatgtacatcatcctcatcggcttctcgagctagaacctgaaccacttcatcaacgggcagaccaactaccccggcgtggccggcaacggcacgacgttctacttcctggtgttcgccatcctggccggcgtggcgcgcgcgacgtccaagctagcgggcgtgcaccacatgcgcgcctggcgccacaacagcctgaacaccaacgccgcagtcacgctcatcgactgcgacatcatcgcgctcagcttcgggctggcctgcaagtagatcgaa

SEQ ID NO: 36284 - DNA, 706 bp, Zea mays
  misc_feature: Ceres CLONE 1419644-F
  misc_feature: Encodes the peptide sequence at SEQ ID NO. 36285
  misc_feature (558)..(558): n is a, c, t, g, unknown, or other
  misc_feature (596)..(596): n is a, c, t, g, unknown, or other
ggagctccccgcggtggcggccgctctagaactagtggatcccccgggctgcaggaattcgcacgagaccattacctagaacatcctaatcgaaaagaagccaatcctccatcaccgccaccgcccgagccccgaggcctaggccctgatctctgcctaccaaacaatggaagccacagcagccaccttgtcccgctccgcctccctctccgccggccgcccccaccgctcccgcaccgccaggttcccgccaccacccccacacctcaccccgctctcggctgccgcgtccccgcgcggcctcccgctccgccgagccaggtccgacgccgaggtcgcctacttcgcgagatccgccgtcctcgtccgccacgctccgatccccgccattatcgtggccgacgaggaagagcgccaggatgacaacagcaaggcgccagcaggcctcgacggcgccggcgccggcaggaacggcagcagccaccgcggcggcagccgaggccgtggcggcggcggcggcggctgtgacatgggcgagtactaccgccgcgtgctgcnggtggatcccgggaacccgctgctgctgcgcaactacngcaagtacctgcacgaagtggagcgcgacctcgcgggcgccgaaggctgctacgcgcgcgcgctgctggcgtgccccgggggacgcgacctgctcagcctctacgggcgc

SEQ ID NO: 36285 - protein, 180 aa, Zea mays
  misc_feature: Ceres CLONE 1419644-F
  misc_feature (131)..(131): Xaa is any aa, unknown, or other
  misc_feature (144)..(144): Xaa is any aa, unknown, or other
MEATAATLSRSASLSAGRPHRSRTARFPPPPPHLTPLSAAASPRGLPLRRARSDAEVAYFARSAVLVRHAPIPAIIVADEEERQDDNSKAPAGLDGAGAGRNGSSHRGGSRGRGGGGGGCDMGEYYRRVLXVDPGNPLLLRNYXKYLHEVERDLAGAEGCYARALLACPGGRDLLSLYGR

SEQ ID NO: 36286 - DNA, 658 bp, Zea mays
  misc_feature: Ceres CLONE 1419660-F
  misc_feature: Encodes the peptide sequence at SEQ ID NO. 36287
aaagctggagctccccgcggtggcggccgctctagaactagtggatcccccgggctgcaggaattcgcacgagaccattacctagaacatcctaatcgaaaaattacaaacccgtcctctgtttgtcctaccaccaccgctcaccgcggtttggctttctcccctcttctgcaccacttctcgctccggattccggattccctctgctctttccctaacgaaggtagccatggcggggagaggtaaggcgatcggctcaggcgccgccaagaaggccacgtccaggagctccaaggctggcctccagttccccgtgggaaggatcgccaggttcctcaaggccggcaagtatgccgagagagtcggcgccggcgcccctgtctacctcgctgccgtgctcgagtatcttgctgcccaccttcttgagctggccggcaatgcggcacgtgacaacaagaagacccgcatcgtaccgcgccacatccagctcaccgtccgcaacgacaaagagctctcccgcttgctgggcacggtgaccatcgctagcggtggtgtaatgcccaacatccataacccttttgctcccaaagaaggccggcggcggcagcgccaaggctgcggctggtgacaaatactaagtccttgacttcgcctgggg

SEQ ID NO: 36287 - protein, 132 aa, Zea mays
  misc_feature: Ceres CLONE 1419660-F
  misc_feature (19)..(92): Pfam Name: Histone Pfam Description: Core histone H2A/H2B/H3/H4
MAGRGKAIGSGAAKKATSRSSKAGLQFPVGRIARFLKAGKYAERVGAGAPVYLAAVLEYLAAHLLELAGNAARDNKKTRIVPRHIQLTVRNDKELSRLLGTVTIASGGVMPNIHNPFAPKEGRRRQRQGCGW

SEQ ID NO: 36288 - DNA, 677 bp, Zea mays
  misc_feature: Ceres CLONE 1419663-F
  misc_feature: Encodes the peptide sequence at SEQ ID NO. 36289
ctggagctccccgcggtggcggccgctctagaactagtggatcccccgggctgcaggaattcgcacgagaccattacctagaacatcctaatcgaaaagaccttccagtcttctccgtaggggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgagaaagatgaagctgcaggtgccaggggataaaggtatttggaggatccctggacaatgtgaaagggctccctgatcggggggagaatggaatgaatttgccctttggaaaggaattgagatactttggcctcccccccccttgcccccttaagggccaatcaccctactttgttcctaaaaggggagggaaaaactccccgctcttccccaaaaatcccttgttccttggggggggggggaaaattttttaagggtttcccaaaacaaattttaccccccccttttgga

SEQ ID NO: 36289 - protein, 73 aa, Zea mays
  misc_feature: Ceres CLONE 1419663-F
  misc_feature: SWISSPROT Homolog: EC 3.1.2.6 Hydroxyacylglutathione hydrolase
MKIIPVPCLDDNYAYLIVDESTKKAAAVDPVEPEKVLKAAGEVGAYVDCVLTTHHHWDHAGGNEKDEAAGARG

SEQ ID NO: 36290 - DNA, 838 bp, Zea mays
  misc_feature: Ceres CLONE 1419677-F
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (28)..(28): n is a, c, t, g, unknown, or other
  misc_feature (29)..(29): n is a, c, t, g, unknown, or other
  misc_feature (35)..(35): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (364)..(364): n is a, c, t, g, unknown, or other
  misc_feature (384)..(384): n is a, c, t, g, unknown, or other
  misc_feature (391)..(391): n is a, c, t, g, unknown, or other
  misc_feature (394)..(394): n is a, c, t, g, unknown, or other
  misc_feature (395)..(395): n is a, c, t, g, unknown, or other
  misc_feature (440)..(440): n is a, c, t, g, unknown, or other
  misc_feature (475)..(475): n is a, c, t, g, unknown, or other
  misc_feature (503)..(503): n is a, c, t, g, unknown, or other
  misc_feature (514)..(514): n is a, c, t, g, unknown, or other
  misc_feature (515)..(515): n is a, c, t, g, unknown, or other
  misc_feature (524)..(524): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (541)..(541): n is a, c, t, g, unknown, or other
  misc_feature (548)..(548): n is a, c, t, g, unknown, or other
  misc_feature (549)..(549): n is a, c, t, g, unknown, or other
  misc_feature (557)..(557): n is a, c, t, g, unknown, or other
  misc_feature (575)..(575): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (617)..(617): n is a, c, t, g, unknown, or other
  misc_feature (665)..(665): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (757)..(757): n is a, c, t, g, unknown, or other
  misc_feature (758)..(758): n is a, c, t, g, unknown, or other
  misc_feature (790)..(790): n is a, c, t, g, unknown, or other
  misc_feature (794)..(794): n is a, c, t, g, unknown, or other
  misc_feature (816)..(816): n is a, c, t, g, unknown, or other
gcccccccccnnncccncccccccccanngatggngtgnnnnnnaaaaactgggactccccgcggtggcggccgctctagaactagtggatcccccgggctgcaggaattcgcacgagaccattacctagaacatcctaatcgaaaaacaacccctgtgggaggagccagagccagagccagccagccagacacacaacctcggtcggcgcggcggctcaacccaatgggtccttcctccctccgcccgccgcgccaacacccgtctcccctcgtcgtcctcgccatcggcggtcctcctcgtcttgcgcaccccccattggctgccccaggccggacgaggaagaggagggggtgggttgttncgggagaatttccggggacnaaaaccntgnnaaggctcccggagttgggggggattttttgatggggaatgggtanccttgtaaaggacgtttcttgaattcggggccccngtttacaagccacccgggggaaaacagnccccctgcgcnnaaaaaaaangtggagggttttnnncngcggggnnctaaaccnaaggggggagaaaataanaaggtnnncttagttgggcgcgccacaaatctctcacccaanatccccgtcgcacccattgaagtcgccgcttttggaaaacacggaccntnnntagttgggctgtggnnnagtagcgaatcggcgggggcgatcgcgattaggtagatcaccactacgtaggcagccgcattgagccaggnntgcgccggagaacaacaacgtgggtagtcagngacncccaactatcggtcgttaatgnctccccggccccagagcacgcg

SEQ ID NO: 36291 - DNA, 693 bp, Zea mays
  misc_feature: Ceres CLONE 1419682-F
  misc_feature: Encodes the peptide sequence at SEQ ID NO. 36292
aagctggagctccccgcggtggcggccgctctagaactagtggatcccccgggctgcaggaattcgcacgagaccattacctagaacatcctaatcgaaaaatctcgtcgctcggctcccgaccgcatcgcgatcagtcatctcctgcgtctcgttctcgccggagatcagacgcgccaccgccgggcgatggatgcctcctaccgccgcgccggtgccggaagcggttctgctccccgctccgtcgaggacatctacaaggactaccgcgcccgccgctccgccgtcctccgcgccctcacccacgacgtcgaggagttctacgcgctgtgcgatccagagaaggagaacctgtgcctatacgggtacgcaaacgaagcgtgggaggtggcgctgccggcggaggaggtgcccacggagctgccggagcctgcgctcgggatcaacttcgcgcgcgacgggatgaaccgtcgcgactggctcgcgctcgtcgccgtccactccgactcgtggctcatatccgtcgcattctactacgccgcgcggctcaaccgaagtgatcgtcgtctccggtggtgtgaagcaatctaaggaaagggacagatccggtactgacaacagtggtagaaataaactgtcagcaaagcaaacaagcgagccacggttagaaaataatgccagggagcctgacga

SEQ ID NO: 36292 - protein, 133 aa, Zea mays
  misc_feature: Ceres CLONE 1419682-F
MDASYRRAGAGSGSAPRSVEDIYKDYRARRSAVLRALTHDVEEFYALCDPEKENLCLYGYANEAWEVALPAEEVPTELPEPALGINFARDGMNRRDWLALVAVHSDSWLISVAFYYAARLNRSDRRLRWCEAI

SEQ ID NO: 36293 - DNA, 720 bp, Zea mays
  misc_feature: Ceres CLONE 1419687-F
  misc_feature: Encodes the peptide sequence at SEQ ID NO. 36294
  misc_feature (496)..(496): n is a, c, t, g, unknown, or other
  misc_feature (517)..(517): n is a, c, t, g, unknown, or other
  misc_feature (565)..(565): n is a, c, t, g, unknown, or other
  misc_feature (581)..(581): n is a, c, t, g, unknown, or other
  misc_feature (584)..(584): n is a, c, t, g, unknown, or other
  misc_feature (586)..(586): n is a, c, t, g, unknown, or other
  misc_feature (587)..(587): n is a, c, t, g, unknown, or other
  misc_feature (598)..(598): n is a, c, t, g, unknown, or other
  misc_feature (603)..(603): n is a, c, t, g, unknown, or other
  misc_feature (606)..(606): n is a, c, t, g, unknown, or other
  misc_feature (607)..(607): n is a, c, t, g, unknown, or other
  misc_feature (621)..(621): n is a, c, t, g, unknown, or other
  misc_feature (622)..(622): n is a, c, t, g, unknown, or other
  misc_feature (627)..(627): n is a, c, t, g, unknown, or other
  misc_feature (647)..(647): n is a, c, t, g, unknown, or other
aagctggagctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagaccggagagaaataggggacaagtacaaggacgcggcggaggaggcgaaggacgccacccgggacgccaaggagcacgccnagaggatgggccggggagacnaagagcagggcgcaggacaaggccggccgcgtgggcgacccagcgtcnggcatggccgaacggnccnanngacaagccaanggccntgnncggaagaccccccnnaaccngccgtcccggggcgaacgancgacccaaaaaccaaccccctgaacccggcccgggaggccccggaccggggcggggcaccttaaagaaccggc

SEQ ID NO: 36294 - protein, 167 aa, Zea mays
  misc_feature: Ceres CLONE 1419687-F
  misc_feature (97)..(97): Xaa is any aa, unknown, or other
  misc_feature (104)..(104): Xaa is any aa, unknown, or other
  misc_feature (120)..(120): Xaa is any aa, unknown, or other
  misc_feature (125)..(125): Xaa is any aa, unknown, or other
  misc_feature (126)..(126): Xaa is any aa, unknown, or other
  misc_feature (127)..(127): Xaa is any aa, unknown, or other
  misc_feature (131)..(131): Xaa is any aa, unknown, or other
  misc_feature (133)..(133): Xaa is any aa, unknown, or other
  misc_feature (134)..(134): Xaa is any aa, unknown, or other
  misc_feature (139)..(139): Xaa is any aa, unknown, or other
  misc_feature (147)..(147): Xaa is any aa, unknown, or other
MSRLMAAMLLGGARVAGAAKLTGNGNAAGMQALPMPACFLPPRPQAATWTRLCLQAAPRSSQAYDNAPEDRREIGDKYKDAAEEAKDATRDAKEHAXRMGRGDXEQGAGQGRPRGRPSVXHGRTXXXTSQXPXXEDPPXPAVPGRTXDPKTNPLNPAREAPDRGGAP

SEQ ID NO: 36295 - DNA, 706 bp, Zea mays
  misc_feature: Ceres CLONE 1419704-F
  misc_feature (429)..(429): n is a, c, t, g, unknown, or other
  misc_feature (432)..(432): n is a, c, t, g, unknown, or other
ggagctccccgcggtggcggccgctctagaactagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcggcagccgtccacgccgcccccgccgcctcggcgccggcgccagcgcgcgcgacgccgcgctcaccgcctccgtgccaggaacacgggcgcagggagcggaggaggaggagggactcgtggaggccgacccggacgcggacgacgtctggcgcgggctgcancancagcgggagcgggaggcgtggctgcggcgggcgtcgaggcccgtggtggtggtcgccggcgaggaggggtcccctcgggacgcctccgcccgctcgggggaaagcggcggggtgggaagggccccgaacctgaccgacgacaacctggaggagctcaagggggtgcgtggatctggggggtcggcttcagcttcccgcgagattccccaaactggtgcggcttgctggccggccctcgaccttcggctactccatgaacccagcgctttcctgg

SEQ ID NO: 36296 - DNA, 647 bp, Zea mays
  misc_feature: Ceres CLONE 1419713-F
  misc_feature (492)..(492): n is a, c, t, g, unknown, or other
aagctggagctccccgcggtggcggccgctctagaactagtggatcccccgggctgcaggaattcgcacgagaccattacctagaacatcctaatcgaaaatccgtcttgccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgtgcttgcacgtcgaagagctactttgtgagggacttggcaggaaagcacgccatactcttcattctctgcccacctctgatgacttcgaagctcangagtacacgtatctcccactcgtgctttcgcacaatgggggttcgacgtggcgggctcaaaccggttttcttaaaacacccatctcggggggaaacggtggaatccttccaccccctccaaccccttttgggggcccattttttttaaacgggaa

SEQ ID NO: 36297 - DNA, 704 bp, Zea mays
  misc_feature: Ceres CLONE 1419714-F
  misc_feature: Encodes the peptide sequence at SEQ ID NO. 36298
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcaacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcctggccggcgtggtgtgcgcggcatccaacctggcgagcgtgcaccacgtgcgcgtctggcgccacgacagcctggccaccaacgccgcgtcgtcgctcatcgcctgatgcatcacagcgctcgccttcgggctggcctgcaatgtagatcatcatcgcagacacgcggatggcacctgcgcttgctggatgc

SEQ ID NO: 36298 - protein, 93 aa, Zea mays
  misc_feature: Ceres CLONE 1419714-F
  misc_feature (14)..(94): Pfam Name: AWPM-19 Pfam Description: AWPM-19-like family
MAGIGRNMVAPLLVLNLIMYIIVIGFASWNLNHFINGQTNYPGVAGNGATFYFLVFAILAGVVCAASNLASVHHVRVWRHDSLATNAASSLIA

SEQ ID NO: 36299 - DNA, 687 bp, Zea mays
  misc_feature: Ceres CLONE 1419717-F
  misc_feature: Encodes the peptide sequence at SEQ ID NO. 36300
  misc_feature (543)..(543): n is a, c, t, g, unknown, or other
aagctggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctnaactacagccaggaatttcgaagcagaatcaacaaaatgaaaaaatcaacaaaaagcttaaaacctacttagaaaccttacaaaaaaaatttaaaaccctctgaggcatctgctttttagatgtatcttaatttattgtagagc

SEQ ID NO: 36300 - protein, 118 aa, Zea mays; identical to SEQ ID NO: 12523
  misc_feature: Ceres CLONE 1419717-F
  misc_feature (13)..(116): Pfam Name: MAP1_LC3 Pfam Description: Microtubule associated protein 1A/1B, light chain 3

SEQ ID NO: 36301 - DNA, 638 bp, Zea mays
  misc_feature: Ceres CLONE 1419718-F
ctccccgcggtggcggccgctctagaactagtggatcccccgggctgcaggaattcgcacgagaccattacctagaacatcctaatcgaaaatccgtcttgccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgtgcttgcacgtcgaagagctactttgtgagggacttggcaggaaagcacgccataactcttcattctctggccaccctcttggatgactttccaaaacctccaagaaaaaacacctgttttttctccccccccttgggtttttcccaaaaggggtgtaaacaggggggcccccccccttctttaaaaaacccaccccggggggaaagagggggaacctccccccccccccccccccctttttggttttttt

SEQ ID NO: 36302 - DNA, 689 bp, Zea mays
  misc_feature: Ceres CLONE 1419723-F
  misc_feature: Encodes the peptide sequence at SEQ ID NO. 36303
  misc_feature (628)..(628): n is a, c, t, g, unknown, or other
gctccccgcggtggcggccgctctagaactagtggatcccccgggctgcaggaattcgcacgagaccattacctagaacatcctaatcgaaaaatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggcccccgtggaggcgaagcaggcgctctactcgagggacctcgctcgcaacctgcgcttcgcctccaacttcgacctcttcaaggctgctgcggccgactggcgcgacacgctcttctgcgnagtggctccgaacccgccgccgcgggaggagctgccggagccactcaggaccgtgatgctc

SEQ ID NO: 36303 - protein, 184 aa, Zea mays
  misc_feature: Ceres CLONE 1419723-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPRGGEAGALLEGPRSQPALRLQLRPLQGCCGRLARHALLRSGSEPAAAGGAAGATQDRDA

SEQ ID NO: 36304 - DNA, 681 bp, Zea mays
  misc_feature: Ceres CLONE 1419744-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (332)..(332): n is a, c, t, g, unknown, or other
  misc_feature (350)..(350): n is a, c, t, g, unknown, or other
  misc_feature (353)..(353): n is a, c, t, g, unknown, or other
  misc_feature (356)..(356): n is a, c, t, g, unknown, or other
  misc_feature (359)..(359): n is a, c, t, g, unknown, or other
  misc_feature (361)..(361): n is a, c, t, g, unknown, or other
  misc_feature (366)..(366): n is a, c, t, g, unknown, or other
  misc_feature (379)..(379): n is a, c, t, g, unknown, or other
nnnnnnnnnnnnnnnnnnnnnnnnnnnnnnnnnnnnnnnnnnnnnnnnnnnnnnttggggnnnnnnnnnaagggnnnnnnnnnnnnnnnnnnnnnnnnnnnnnnnnnnnnnnnnnnnnnnnncccaaactgggacttcaccgcggtggcggccgctctagaactagtggatcccccgggctgcaggaattcgcacgagaccattacctagaacatccaatcgaaaatgcccagtcctgaatcacgtcttcacccgtgctcgtgcgctgcgcccatcccttcccgcctcacgctccccacgtgcaccgtgcaccgtgcacagcaccacacagnccagtccccatgggcgcngcngcngcngnttgcntctgccaacgacngcggaagaagaagccgcgcctgctgcgccctggaggaaccaggcgggaacaagggcgggggggggggccctggggaataccctttggcttcgccccggcgggttcccgggcccccccgcccccgttaaagttctccccggggtggggcctcccccctctccaaaaaaaaaccctcccccgggggcttccggggtttttttttctaaaaaaaaggggggaaccccctctcacaaaaaaaattgggtcccccccccggcgcgccccaataaattttttccccccccccccctccccccattttg

SEQ ID NO: 36305 - DNA, 642 bp, Zea mays
  misc_feature: Ceres CLONE 1419752-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (452)..(452): n is a, c, t, g, unknown, or other
  misc_feature (518)..(518): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatcccccgggctgcaggaattcgcacgagaccattacctagaacatcctaatcgaaaaaacagcgtcctcctcccgcgtgctctccactcccagaccccggggactacaaggggcactgggctaggtccgttggcaacagccgccacactgctccgctctgctctctggaagcattgcctgcctcgagttgtcatggncgcagcgggaacgcagctgggtcggctcccttgttgcggcctctggctcctggccgcgtgctgcancggggcgctgcggcggcagtggccgccctggatgggcgggcccgccatcgcagcgaccggggaaaaacttcgtgtgcccgaaattggactggggggccccccgaacaatgggcaccattggccc

SEQ ID NO: 36306 - DNA, 496 bp, Zea mays
  misc_feature: Ceres CLONE 1419753-F
  misc_feature (288)..(288): n is a, c, t, g, unknown, or other
  misc_feature (313)..(313): n is a, c, t, g, unknown, or other
  misc_feature (377)..(377): n is a, c, t, g, unknown, or other
ctccccgcggtggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatgggctgctcccacgggnaaagatgtgcgccttcagaggaggnctaacttcaaaaagtaaaaaggggctaaagggggcttttacttcaccaaaaggggagggggggnccccctttttaaaaaaccccccacgggggggcaaaaaagcttcgaaaacccgggggggggtcccccccccccccacaaaggggaaagaaatgttttttttttaaaaacaaaaacccctc

SEQ ID NO: 36307 - DNA, 501 bp, Zea mays
  misc_feature: Ceres CLONE 1419754-F
  misc_feature: Encodes the peptide sequence at SEQ ID NO. 36308
  misc_feature (41)..(41): n is a, c, t, g, unknown, or other
  misc_feature (291)..(291): n is a, c, t, g, unknown, or other
  misc_feature (311)..(311): n is a, c, t, g, unknown, or other
  misc_feature (325)..(325): n is a, c, t, g, unknown, or other
tcaccgcggtggcggccgctctagaactagtggatcccccngggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcangctccttcccatgcccgcgntggtttcccttccnccccggcccgcagggggagggacctgtgaaccccccccttggttggggggttgccaaaaattcccccggtaaaacaaaaccccccgaaaaaacccgaaaaaaaataggggggaaaattttaaagggaaccccccctaaaaaggggaaaaaaaaccccccccggggggggcaccccc

SEQ ID NO: 36308 - protein, 51 aa, Zea mays
  misc_feature: Ceres CLONE 1419754-F
  misc_feature (31)..(31): Xaa is any aa, unknown, or other
  misc_feature (38)..(38): Xaa is any aa, unknown, or other
  misc_feature (43)..(43): Xaa is any aa, unknown, or other
MSRLMAAMLLGGARVAGAAKLTGNGNAAGMXAPSHARXGFPSXPARRGRDL

SEQ ID NO: 36309 - DNA, 720 bp, Zea mays
  misc_feature: Ceres CLONE 1419758-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (343)..(343): n is a, c, t, g, unknown, or other
  misc_feature (352)..(352): n is a, c, t, g, unknown, or other
  misc_feature (358)..(358): n is a, c, t, g, unknown, or other
  misc_feature (359)..(359): n is a, c, t, g, unknown, or other
  misc_feature (372)..(372): n is a, c, t, g, unknown, or other
  misc_feature (375)..(375): n is a, c, t, g, unknown, or other
  misc_feature (436)..(436): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactccccgcggtggcggccgctctagaactagtggatcccccgggctgcaggaattcgcacgagaccattacctagaacatcctaatcgaaaaacattcctttctctccctctcgccgtcgtcgccacctccacttggccccgctcatcgcctcctccgacgaccaccgtcccacggcgacgaggacagcgacgatgcagtcgggcgcgtgtaaggtngtcactctngacganncactctccccttnaanctcggttggcatcgcccgccttcagatccgcctcccagcccggggctcgctccccaaaggnttgtttgggaccggatgggcccaaaattccatgtctggcaaggccccccgcgggcaaagggttccccgggcatctcctccccccaagggctccccgaaggggagggcctttgtgggaagggggaattttaccccccgcgggggtgtggaaccccccggggggttttcttgggggccccttttttttgggcaacaaacttttccccaaaaagggggggcccaaaaagggttttgtccccccactaaaaaggggggggggggggattccctccccctccccccccc

SEQ ID NO: 36310 - DNA, 580 bp, Zea mays
  misc_feature: Ceres CLONE 1419759-F
  misc_feature (304)..(304): n is a, c, t, g, unknown, or other
aaagctggagctccccgcggtggcggccgctctagaactagtggatcccccgggctgcaggaattcgcacgagaccattacctagaacatcctaatcgaaaaacacacactcgactctcctctctcgcatccgcagcctctcgagctctactccatcccctcgatctcgaagcgcagcagcagcagtcaggcggccatggacgccagcgcagccggagccggcgggaaggcgtagaaaggcgcggccggacgtcaggacaggcggacgagaaagaagtcggtgacgaagtccgtcaaggccggnctgcagttccccgtccgacgcatcggggcggtacctgaagaaggggccgtacgcgcagcgcgtcagcacgggcgcccccgtctacctgggcggccgtcctccagtacctggccccccaggtgcttggactgggccggaaaccgggcaaaggaaaaaagaaaaaccggattattcccgggccagttggtcctggggcatccccaaaaaaacaaagaaatctcggaaaaattgttttttccgggggtccccctttccccccagggggggggtccttcc

SEQ ID NO: 36311 - DNA, 633 bp, Zea mays
  misc_feature: Ceres CLONE 1419771-F
  misc_feature: Encodes the peptide sequence at SEQ ID NO. 36312
  misc_feature (371)..(371): n is a, c, t, g, unknown, or other
  misc_feature (373)..(373): n is a, c, t, g, unknown, or other
  misc_feature (379)..(379): n is a, c, t, g, unknown, or other
  misc_feature (380)..(380): n is a, c, t, g, unknown, or other
  misc_feature (455)..(455): n is a, c, t, g, unknown, or other
aagctggagctccccgcggtggcggccgctctagaactagtggatcccccgggctgcaggaattcgcacgagaccattacctagaacatcctaatcgaaaaaaacactacatgcacgctagtggctagcactgccgcagtaggtcagtcgggtgtacgtacggtgccatggcctcggcctccctgccgctcctcgtcatcgtcctcctcgtctcggtcgtcggagcttgcactcgtgctgccgaggcggcggctacccgtaggaaggacgatgtcatcacaacaaccaccagcagcagccgtggatcatcctcaccgtcgtcgtcacccctccccagagcagcagcagagaagaaatgagagcccaaaggncngtggcnngcgcgacgtcccgcgaagaagcccgtcgccgccggcccaagtgcgtgacgaagcaaggactgccacctcaaagcngctggtgtgccgccaagaagtgccaccatggccgcaccacaacaagtgcgcccggccaattgttcccactccttgaaaacgccctccccatcttgcaccctagttggacatggcatgctaaggtaaaccccccagtaaaaatatttattttattttaaaaaaaatggaccacattggt

SEQ ID NO: 36312 - protein, 63 aa, Zea mays
  misc_feature: Ceres CLONE 1419771-F
MASASLPLLVIVLLVSVVGACTRAAEAAATRRKDDVITTTTSSSRGSSSPSSSPLPRAAAEKK

SEQ ID NO: 36313 - DNA, 651 bp, Zea mays
  misc_feature: Ceres CLONE 1419776-F
  misc_feature: Encodes the peptide sequence at SEQ ID NO. 36314
  misc_feature (453)..(453): n is a, c, t, g, unknown, or other
aagctggagctccccgcggtggcggccgctctagaactagtggatcccccgggctgcaggaattcgcacgagaccattacctagaacatcctaatcgaaaaactatacctgtacgcttcaagcaaaaccctacctgatcccaccagcgtggtagagtctgctcaacaccaaacttcgacgactgcgccggccgtcggccgtcgctgccgccctattttgaccccatcgccggcgacgataatcgccagctgaaggacaataactatcatggatgctactgcaaattcagatgtgcaaagggctgaggaatttaaacttaaggcgaatgatgccttcaaggcaaacaagttctcgcaggctatagagctttacagtcaagccattgagctgaatagttcaaatgcagtttactgggcaaaccgtgcatttgcacacacaaaattagagaatacngaagtgctgtgcaggatgctacaaaagccatcgaaattgattctagatatccaaaggttattatagacgaagcccagcttatcttggcatgggaaagttcaaggaaccctgaaagattttcagcaggtaaaaaaatctgccaaatggtcccaaagctacaagaaagtggagaaatggcaaaaaactgttcaaaaaatc

SEQ ID NO: 36314 - protein, 83 aa, Zea mays
  misc_feature: Ceres CLONE 1419776-F
  misc_feature (12)..(45): Pfam Name: TPR_1 Pfam Description: Tetratricopeptide repeat
  misc_feature: SWISSPROT Homolog: EC 3.1.3.16 Phosphoprotein phosphatase
MDATANSDVQRAEEFKLKANDAFKANKFSQAIELYSQAIELNSSNAVYWANRAFAHTKLENTEVLCRMLQKPSKLILDIQRLL

SEQ ID NO: 36315 - DNA, 584 bp, Zea mays
  misc_feature: Ceres CLONE 1419786-F
  misc_feature: Encodes the peptide sequence at SEQ ID NO. 36316
aaagctggagctccccgcggtggcggccgctctagaactagtggatcccccgggctgcaggaattcgcacgagaccattacctagaacatcctaatcaaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctcccgtctatatgccgcctccgttctatctgccgccgcagcagcagccgcagccatgggcataccccactcaaccaccgcagctaagccgggtgcagcagttcggatcctgcggcgtcggcagcgtcggcagcccgtttcctgggccagtgcgtcaaagttcctgagggaaaagtgcagcccgggggggaaccccttagggttcgccaaatgcccagcgcctcaacaacaatgctgcccccaataagggcagggggaaccccttcaccggtcccgggaaaattaagggggggccctgaaaatctttccgc

SEQ ID NO: 36316 - protein, 90 aa, Zea mays
  misc_feature: Ceres CLONE 1419786-F
MKVLIVALALLALAASAASSTSGGCGCQTPPFHLPPPVYMPPPFYLPPQQQPQPWAYPTQPPQLSRVQQFGSCGVGSVGSPFPGPVRQSS

SEQ ID NO: 36317 - DNA, 638 bp, Zea mays
  misc_feature: Ceres CLONE 1419788-F
  misc_feature: Translation starting site: 110
  misc_feature (42)..(42): n is a, c, t, g, unknown, or other
  misc_feature (43)..(43): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (257)..(257): n is a, c, t, g, unknown, or other
aaagctgggagctccaccgcggtggcggccgctctagaactnnagtggatcccccgggctgcaggaattcgcacgagaccattacctagaacatcctaatcgaaaaacaatgagtccgcgcccacggccgaggcagctgcaggcagcggcccgtccggcggagaagggcggaagggcaaggcgcccaagggcgggcccgagaacggcagttccggtaccgcgnnncgtgcgcagcgaactggggcaagtgggtggcngagatccgcgagcccgcgaagcgctcccgcagtggctcggcaccttcgccaccgccaaggacccgggggggcctagaacggggcggggtccttctttaggggccccgggggcacttaaaccttacctccccaacggcgcctaattttgggggggcgggttttgaaccggaattttctttccccccattttttttgcccccccaagggttccccccgtttttttgggggcccccaaattgaaaaattttctcaggaattggggccccccccccggtttttccctctcccaaaaatttttttggggccctttttttttttcccccgcgcaccccccgcttttttttttccccaccacgggcgccggggggtccaaaataaaac

SEQ ID NO: 36318 - DNA, 651 bp, Zea mays
  misc_feature: Ceres CLONE 1419795-F
  misc_feature: Encodes the peptide sequence at SEQ ID NO. 36319
aaagctggagctccccgcggtggcggccgctctagaactagtggatcccccgggctgcaggaattcgcacgagaccattacctagaacatcctaatcgaaaactcctcaactcggcgtctggcttctgcgccttcgttttcggcctctggcccttgcgagttctatctcacctccaaggatggggaagaaggagtccaacatcttgtttgtggttctcggccatgtcgactctggcctctccttcacctgctgcacaccttatctactagcttggaggcattgaccaccgtgtgatcgagatggttgacaatgaggctgctgaattgaataaacggtctttcaattacgcgggggtgctcgacaagctcaaggctgaacggattactaggatcacctttaagcttgctctgagctagtgtaagaccaccacatacgactgctctgtcattgatgcccatagacaccgtgtcttctttaggaagatgctcacgggtatgtcccgggttgactgcgctgaccttataatggataccaccacgggcggttttgagggagctatctctcacgatggccactcacgtgaacatgctctccatgggtccagccttgaactgaaggagacgattgctgatacatctagatggatgctg

SEQ ID NO: 36319 - protein, 38 aa, Zea mays
  misc_feature: Ceres CLONE 1419795-F
MVDNEAAELNKRSFNYAGVLDKLKAERITRITFKLALS

SEQ ID NO: 36320 - DNA, 653 bp, Zea mays
  misc_feature: Ceres CLONE 1419797-F
  misc_feature: Encodes the peptide sequence at SEQ ID NO. 36321
  misc_feature (1)..(1): n is a, c, t, g, unknown, or other
naaagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacgggcatgaggtcttgctgtttgaagctcttcgtgaggccttgatggaagaaatgcattaagatcccaccgtgtgtgtatttgggtaaaaatgttggcaattacggtgggttcttacaaggtgacaaaagggtttgcctgaaacgtttggaaacctttcagatttctgaaacccccatttgcgaaaaaacccgtttcctggcatgggaaatttgacccggaaaaaaaagggctaaagcccccccctttaaagggataaaaaacggggatccccgggccccttggttaaaacccagaattcaaaaaaaaaaggggggaggggttctattaacacttccc

SEQ ID NO: 36321 - protein, 78 aa, Zea mays
  misc_feature: Ceres CLONE 1419797-F
MATAFSLRAAAPATAPRAVSRSTSAARVVPVASALAGRGRLVARAAVTAKADVPSSTSDGHEVLLFEALREALMEEMH

SEQ ID NO: 36322 - DNA, 662 bp, Zea mays
  misc_feature: Ceres CLONE 1419798-F
  misc_feature: Pfam Name: PHF5 Pfam Description: PHF5-like protein
  misc_feature (337)..(337): n is a, c, t, g, unknown, or other
acaagctggagctccccgcggtggcggccgctctagaactagtggatcccccgggctgcaggaattcgcacgagaccattacctagaacatcctaatcgaaaaagaccttattccctcccctcccctcccctccctttctcccctgactcctgctctactggatcctccgcctccatcgcctctcgcgcctccatcgacctcggcgcctcgtccgtcctgctccacctcttcttacgccggggttacatttgaggcatggcgaaacaccacccgacctgatcatgtgccggaagcaggccggcatcgccatcggggcgctgttgcaaaaatgcgacnggcaaatgcgttctctgcgaatcttacgtgcggccctgcacgcttgtccccgtctgcgaccagtgccactaccggtcctttccggggcggtgcgtcatctgcggcgggtggggatctctggaagcctactactgtaagggttgccccccccacgagaaaggacccggacggggggccccaaaatatccaaactccggaacgccccagaacgacatccttctacaaaagcaaaaaaataccggggtccacgaagaagggggacagggcacctcccctttaggcaccccccgaaatgggttttcccggggtcttctgtcctcagaaa

SEQ ID NO: 36323 - DNA, 747 bp, Zea mays
  misc_feature: Ceres CLONE 1419802-F
  misc_feature: Encodes the peptide sequence at SEQ ID NO. 36324
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
gattttggggggtgtgtgtnnnnccacctgcggggccctcgtttttaaactnnnncccaaactggagctcaccccggtggcgggcgctctacaactagtggatccccctggctgcaggaattcgcacgagaccattacctagaacatcctaatcgaaaaacactaccaccgctctctcttcctctcctcggtctctcaacgcctgaagctcaccgcacctcccctcctcgccgcggatcccccactactccggtagaaaatggctgacgctgaggatatacagcccctcgtctgcgacaacggaactggtatggtcaacgctgggttcgccggcgacgacactccgagggccgtcgtcgccagcatcgttgggcgcccgcgccacaccggagtgatggtggggatggggccagatggatgattacgtaggtttattttaacaatccaagaggggtatcctgacccttaaggaccgcaccaagcacggaatcgtcatccactgcgaacgacatgaagaagatttggagtgagaagttgtacaaccagctccgtgtggggcgccgaggaacacgccgtcctccctaacggaggggccgctgaaccctaagggtaaccgtgagaagacgaccccacatccatgttccaagagcttgcaacagccccggctatgtacggtccgccatccgcgggccgttcccgttcgctggaaggccgggggggtacctatccccaggtgttttgttggct

SEQ ID NO: 36324 - protein, 53 aa, Zea mays
  misc_feature: Ceres CLONE 1419802-F
  misc_feature: SWISSPROT Homolog: EC 2.7.10.2 Non-specific protein-tyrosine kinase
MADAEDIQPLVCDNGTGMVNAGFAGDDTPRAVVASIVGRPRHTGVMVGMGPDG

SEQ ID NO: 36325 - DNA, 740 bp, Zea mays
  misc_feature: Ceres CLONE 1419813-F
  misc_feature: Translation starting site: 288
tggagctccccgcggtggcggccgctctagaactagtggatcccccgggctgcaggaattcgcacgagaccattacctagaacatcctaatcgaaaaattaaaacctgattttaccacccaactgctgtcttgtaagaagaagccgcaaaactcctgatcaccaacccatccatcccccagtcctcctcactgctcacccgtctcccatccccacaccaccaccaccaccatcttccggtcttcccctccccacacccggggggatccccaccatccccgccccccgatggagctgttcgcgcgccgccaggtggttgcgctcaagagccaccacgacaagttcctgtacgccgaccaagacgaagtcgcacgtggacccaggagcggggacgggtccttccgcaaaacccccggtggggcgtgtaaccgggcccccaaaaaccgggggccaatcgcctggtgagccgggaaggccaatacctaaccgcccccgggggaaacctttcctcttggggaaaaaagggccccaaagggtaaacaaaaaaggggccccgccgtcccccccacccccccaaaaagttttctttggaaaagggaaaaccccttggggggaaaaggttttttaagggggcgcccctcctcccaccaaagggggggggggccaaatttttttcctccgggaaaaaaaaggggggggggttccctccccccccccgggggggaaaaaaaaacttcctct

SEQ ID NO: 36326 - DNA, 763 bp, Zea mays
  misc_feature: Ceres CLONE 1419817-F
  misc_feature: Encodes the peptide sequence at SEQ ID NO. 36327
aaagctggagctccccgcggtggcggccgctctagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacgggagagattccacctccctaaacctgaaccagctctggaagaaggttaggggggaagaacaaggcacggcacattcttggtgcaagcgaaaattacaattgaaacattggttcaaaattttatgaaggcaaaacgggactttgggttcccacttccctttcccccggatgggaaaaaattttttggcatttcaaagctgttgaagggaaactttttttttccccaaacggaaaaattccccggtgtccccccccccataatggagggcccaaaacccccttttgaggggtcttttttgaaaacacttaagacaggggactttttttttgttccccccaaaatttcaaaagggggttttcccgggggcaacc

SEQ ID NO: 36327 - protein, 80 aa, Zea mays
  misc_feature: Ceres CLONE 1419817-F
MDEEYDVIVLGTGLKECILSGLLSVDGLKVLHMDRNDYYGRDSTSLNLNQLWKKVRGEEQGTAHSWCKRKLQLKHWFKIL

SEQ ID NO: 36328 - DNA, 731 bp, Zea mays
  misc_feature: Ceres CLONE 1419821-F
  misc_feature: Encodes the peptide sequence at SEQ ID NO. 36329
  misc_feature (520)..(520): n is a, c, t, g, unknown, or other
  misc_feature (540)..(540): n is a, c, t, g, unknown, or other
  misc_feature (709)..(709): n is a, c, t, g, unknown, or other
aagctggagctccccgcggtggcggccgctctagaactagtggatcccccgggctgcaggaattcgcacgagaccattacctagaacatcctaatcgaaaattcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcatgnccggcgtgttgggcgcggcntccaagcttgcgggcgtgcaccacgtgcgcgcctggcgcacgacagcctgcccacaacggcgcgtcgtcgctcatcgcctgggccatcacggggctccgcctcgggctggcctgcaggagatccacttggcggaacacgcggctggccctgcacttgctgaaagcctcntatcatcctcgctttacgaagt

SEQ ID NO: 36329 - protein, 129 aa, Zea mays
  misc_feature: Ceres CLONE 1419821-F
  misc_feature (14)..(115): Pfam Name: AWPM-19 Pfam Description: AWPM-19-like family
  misc_feature (60)..(60): Xaa is any aa, unknown, or other
  misc_feature (123)..(123): Xaa is any aa, unknown, or other
MAGIGRNMVAPLLVLNLIMYIIVIGFASWNLNHFINGQTNYPGVAGNGATFYFLVFAIMXGVLGAASKLAGVHHVRAWRTTACPQRRVVAHRLGHHGAPPRAGLQEIHLAEHAAGPALAESLXSSSLYE

SEQ ID NO: 36330 - DNA, 730 bp, Zea mays
  misc_feature: Ceres CLONE 1419827-F
  misc_feature: Translation starting site: 185
  misc_feature: SWISSPROT Homolog: EC 1.11.1.7 Peroxidase
aagctggagctttaccgcggtggcggccgttctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgagggcggtcggcgccaacgcgaccatgtcatcgtcctggctcctcccgcatggctgcagcagactgcattcgggcatgaaggcgttacaggacttgagaatatacgaagccgcaaggcccgagctcgaaagatgcatgccctggggttgtctcggggcgcagaacatttgttgccttggctgcacgtgatgcaatatctttggcgaatgggaccggcgtatgaggtgccaacaggaagaagagacggtcgggtttcgaacttgtcgctggctaaggacatgcctgatgtaagtgactcgattgagaaacttaagggataattcatggcggaagggactccacgcaaaagaactcgtccttctcagggctgctcatactaacggg

SEQ ID NO: 36331 - DNA, 814 bp, Zea mays
  misc_feature: Ceres CLONE 1419827-R
  misc_feature: Encodes the peptide sequence at SEQ ID NO. 36332
  misc_feature (1)..(1): n is a, c, t, g, unknown, or other
  misc_feature (2)..(2): n is a, c, t, g, unknown, or other
nncccgattgggtaccgggccccccctcgaggtcgacggtatcgataagcttttttttttttttttttgtcatcaaaagcttggaaatgcttgaaagagagatcctggttacagaagctaacgttgagtacagacagtaggcagagattcggattccaacgtgaatggaatagctttatttatctgttcgttattctgctattcaactcgcaaggagatttgggcggatggagtggagatcacttggtatactcgaggacggcatagaaggggtcgagatagatggctcggaaggcggtgaagcctgcggcgtcgacgccgaggtggcggaactcctcctcggagcgctccctcccctgcgtccggtaggtggtcatgacgaagatgtcgttctccagcagcgccctcgtcctggtgctgctgtccgtctccctccgcaccaccgggctcgcagggcaccaggcttgccgccctccggcaaaacggcgtgggcagtttccccaggattgccgggcactccgtcgtcgggccaaggtcgtccgaaaccactttcttgaaaaatgggcttccccgggaggggaagggactttaaacatttctccccccaaacttgccttccttcccgggaatgggggggggctttcgggggaaaaacacttcggggaaggggccaaaatttaattcccccccggggaaattgtggggggaccctggggcatgaaatctttttccagggggaggggccccgggaaacttccccccccgaggtttttaaaaagagcgtgggggaaccccccccccaaaacaccccccg

SEQ ID NO: 36332 - protein, 109 aa, Zea mays
  misc_feature: Ceres CLONE 1419827-R
MEWRSLGILEDGIEGVEIDGSEGGEACGVDAEVAELLLGALPPLRPVGGHDEDVVLQQRPRPGAAVRLPPHHRARRAPGLPPSGKTAWAVSPGLPGTPSSGQGRPKPLS

SEQ ID NO: 36333 - DNA, 724 bp, Zea mays
  misc_feature: Ceres CLONE 1419830-F
  misc_feature: Encodes the peptide sequence at SEQ ID NO. 36334
gctctatatctagtggatccccccggctgcaggaattcgcacgagaccattacctagaacatcctaatcgaaaagtggtctctgtacttccgttcacttcttcagcggcggcgtgacaacgagagcaagaaagtatcaaaacccgagagcaatggaggcggtggggaagagcgtgtgcgtgaccggcgcgggcggcttcatcgcgtcgtggctggtgaagctcctcctctgccggggccaatacaaggtccgcggcaccgtgcgcgaccctggtgctagcaagaatgctcatctcaaggtgctggaaggagctggggaaaggttgcagcttgtcaaggctgatttgttggactacagcagtgttgcttcagcaattgccggctgtgagggtgtcttccatgtagctagccctgtcccttccggtcggtcctccaaccctgaggtggaggtcataggtcctgctgtaacaggtacaaccaatgtgttaaaggcttgctatgaggcaaaagttgcgcgagttgtggtggtgtcttcatgtgcagctgtctatgctaatcctaattatcccaagggtaaggtctttgatgaagactgctggccagatgaagcttactgcaagaagaacgatgatttggtattttcgttcccaaaacactgggcggaacgagtacgcttttgcctatgccaccaaaaacagtggctggaagttataactatttgcccg

SEQ ID NO: 36334 - protein, 191 aa, Zea mays
  misc_feature: Ceres CLONE 1419830-F
  misc_feature (8)..(190): Pfam Name: Epimerase Pfam Description: NAD dependent epimerase/dehydratase family
  misc_feature: SWISSPROT Homolog: EC 1.1.1.219 Dihydrokaempferol 4-reductase
MEAVGKSVCVTGAGGFIASWLVKLLLCRGQYKVRGTVRDPGASKNAHLKVLEGAGERLQLVKADLLDYSSVASAIAGCEGVFHVASPVPSGRSSNPEVEVIGPAVTGTTNVLKACYEAKVARVVVVSSCAAVYANPNYPKGKVFDEDCWPDEAYCKKNDDLVFSFPKHWAERVRFCLCHQKQWLEVITICP

SEQ ID NO: 36335 - DNA, 749 bp, Zea mays
  misc_feature: Ceres CLONE 1419835-F
  misc_feature: Encodes the peptide sequence at SEQ ID NO. 36336
aaagctggagctccccgcggtggcggccgctctagaactagtggatcccccgggctgcaggaattcgcacgagaccattacctagaacatcctaatcgaaaactcgtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacgggtcgtcttcttgttcgggggaggaggcggtggtggtgtaccagagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgtcttcgacgactgcgtcgtcaagggcggcgccgccttgggaacccagcgagaccgtctccttccagtactccaaactccttctcctaccagctcagtgtcgccctccgttcgcgtgccactagaagatcctccacccactactacttagatgatcactcg

SEQ ID NO: 36336 - protein, 179 aa, Zea mays
  misc_feature: Ceres CLONE 1419835-F
MGEWCFKKRAALVIIVAIISSLQLLLITAQEAGGDHEVWSSSSSPAGGRGGGAVVVPTARMGPDGSSSCSGEEAVVVYQSSANPLPSGIPAYTVQIINVCGGGCTVYDVHVSCGDFASTELVDPAKFQRVVFDDCVVKGGAALGTQRDRLLPVLQTPSPTSSVSPSVRVPLEDPPPTTT

SEQ ID NO: 36337 - DNA, 729 bp, Zea mays
  misc_feature: Ceres CLONE 1419837-F
  misc_feature: Encodes the peptide sequence at SEQ ID NO. 36338
aaactggagctccccgcggtggcggccgctctagaactagtggatcccccgggctgcaggaattcgcacgagaccattacctagaacatcctaatcgaaaaatttatcttgttgatactgattttcttgtcttcttcactctcgactgagagaaacaaaacctttttcaaaacctttggacaatgtcgatgttaatggccgctaaatccacttcactctgctactcaaacccatctatctcgcccacaaccaagccaaacccaccctcctgcgcatctgcgtttccgacagcaattaagtgcgcaacgatgacatccgtatactgagagatatagagcagtactacagcacacaaattgacgagatgccaatgaatgttgctgatcttatttgagcagcaagaggatcgggaggggagcttcttgtgttggcttgaggcccttggcgcgagtgtggctgtggactggagcagaatgggctttgtagttgggtgtggagcagagattatttccgtttttgccatggcatgaactgtatatattttagctcgctccagctcatgtaacactttgttgctgcgtttgtgcttgggatacgaagacctgtgttgatggcttcgttagtgtgacactgatttggcgtcggatttttgtttgtcatctgtcattcctgtgctgatctgaaatgctgttttgttatttatattatttatacattactatcaattat

SEQ ID NO: 36338 - protein, 48 aa, Zea mays
  misc_feature: Ceres CLONE 1419837-F
TGAPRGGGRSRTSGSPGLQEFARDHYLEHPNRKIYLVDTDFLVFFTLD

SEQ ID NO: 36339 - DNA, 682 bp, Zea mays
  misc_feature: Ceres CLONE 1419838-F
  misc_feature: Encodes the peptide sequence at SEQ ID NO. 36340
  misc_feature (374)..(374): n is a, c, t, g, unknown, or other
  misc_feature (377)..(377): n is a, c, t, g, unknown, or other
  misc_feature (398)..(398): n is a, c, t, g, unknown, or other
atagctggagctccccgcggtggcggccgctctagaactagtggatcccccgggctgcaggaattcgcacgagaccattacctagaacatcctaatcgaaaaacaaacaacaaatcactccgttgagccttcaccatcacctccctctctggctctctctctctctcacgcatacgaacacactctctactagtactaacctctcactaatctatatctagcagcaagcacacaccgtaacatcaaagccaacgacgacgcggggccggccgcccatggccttcacgtccttattgggcagcgacgcggagcggaagggtggcgtggcggaggtggcgctgcgggcggtgctgtgcgggctaggcgcgctggcngcngcgctggtggcaacggacacncagacgcgcaccttcttctccctgcagaagaaggcgacctacacggacatgaagggccatggtgctccctggtggccgccgcgggcaccggccgccggctacaccctgctgcaggcggcgcccttcttgctgtttgcttccccctgttgggcaattccatcccccccccgggcccccctggtggtgggctgggggctctttcccggggaaaccgggccttggttaacccccttttgggccccctcccccccccccgttaaaggccccccttttcccaaaaaaag

SEQ ID NO: 36340 - protein, 135 aa, Zea mays
  misc_feature: Ceres CLONE 1419838-F
MAFTSLLGSDAERKGGVAEVALRAVLCGLGALAAALVATDTQTRTFFSLQKKATYTDMKGHGAPWWPPRAPAAGYTLLQAAPFLLFASPCWAIPSPPRAPLVVGWGLFPGETGPWLTPFWAPSPPPVKGPPFPKK

SEQ ID NO: 36341 - DNA, 741 bp, Zea mays
  misc_feature: Ceres CLONE 1419839-F
  misc_feature: Encodes the peptide sequence at SEQ ID NO. 36342
  misc_feature (708)..(708): n is a, c, t, g, unknown, or other
acaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaagcgtgcgagtggcattacggaaaggacaccccgcggaagatggaatgcgagagcgagtgccgcgagcggcaccaacaagctgacgcgggcgaggacggcgacagcggcgtgtacgcctacgtctcccgctccgggaggggcgagtgccggcgccagtgcctgctccgccacgagggccagccgtgcgagacccaagagtgcatgaggcggtgccgccgccgcggactggccgtctacatggagcaagagtacggtcgctgcagcgagagcacgtgcaagtgcctggagaggtgccagcgccaccaccgcgaggactggtgggagaggcagcgctgcctgatggactcaaaanccccggtaccggcacgagcacgttcgcatctgc

SEQ ID NO: 36342 - protein, 175 aa, Zea mays
  misc_feature: Ceres CLONE 1419839-F
  misc_feature (165)..(165): Xaa is any aa, unknown, or other
MGKGSVGASWWAFLLLAGVLLVVAATAGAEDGVVERDRKEDLRWCKQACEWHYGKDTPRKMECESECRERHQQADAGEDGDSGVYAYVSRSGRGECRRQCLLRHEGQPCETQECMRRCRRRGLAVYMEQEYGRCSESTCKCLERCQRHHREDWWERQRCLMDSKXPVPARARSHL

SEQ ID NO: 36343 - DNA, 712 bp, Zea mays
  misc_feature: Ceres CLONE 1419850-F
  misc_feature: Encodes the peptide sequence at SEQ ID NO. 36344
acaagctggagctccccgcggtggcggccgctctagaactagtggatcccccgggctgcaggaattcgcacgagaccattacctagaacatcctaatcgaaaaattatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatcccccagaccaatgagaactacaggctgctgtacgataccaaggggcgcttccgccttcacccaatcagggatgaggatgcttaagttcaagcttttcagggtaggcctgttccattttgggcaaaagggcatccccttactaaacacgtttgagggccgcccaatcccgataccctgacccccttattaagggcaaggaacccccttaagatcgtttgggaaaccaaaaaaatttgggactc

SEQ ID NO: 36344 - protein, 119 aa, Zea mays
  misc_feature: Ceres CLONE 1419850-F
  misc_feature (3)..(40): Pfam Name: RS4NT Pfam Description: RS4NT (NUC023) domain
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPQTNENYRLLYDTKGRFRLHPIRDEDA

SEQ ID NO: 36345 - DNA, 728 bp, Zea mays
  misc_feature: Ceres CLONE 1419858-F
  misc_feature: Encodes the peptide sequence at SEQ ID NO. 36346
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtcttangggtggtatgcagatctttgtgaaaacccttactggcaagacatcactcttgaggtggagtcttcagatac

SEQ ID NO: 36346 - protein, 173 aa, Zea mays
  misc_feature: Ceres CLONE 1419858-F
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (150)..(150): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLXGGMQIFVKTLTGKTSLLRWSLQI

SEQ ID NO: 36347 - DNA, 686 bp, Zea mays
  misc_feature: Ceres CLONE 1419862-F
  misc_feature: Encodes the peptide sequence at SEQ ID NO. 36348
  misc_feature (686)..(686): n is a, c, t, g, unknown, or other
agctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggan

SEQ ID NO: 36348 - protein, 154 aa, Zea mays
  misc_feature: Ceres CLONE 1419862-F
  misc_feature (49)..(155): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLL

SEQ ID NO: 36349 - DNA, 689 bp, Zea mays
  misc_feature: Ceres CLONE 1419863-F
  misc_feature: Encodes the peptide sequence at SEQ ID NO. 36350
  misc_feature (360)..(360): n is a, c, t, g, unknown, or other
aagctggagctccccgcggtggcggccgctctagaactagtggatcccccgggctgcaggaattcgcacgagaccattacctagaacatcctaatcgaaaaatgctcttcgccccctcgcgcttaccgctgccgcgcctcccgactcgccgcctccgcctagctccgggctctccaatggcctccatgctcgccatcctcaggccctcggcgccggccccgctcgcgggacgccgggccagggctgccgcgccggcgaccgcgagggtggcgctatctaccagatctaggtattcgtcagccagggtgtcgctcggctccgaggttgcagtgggcgccgacgcgctcttcgccgactatnagcccaccaccgctttcctcttccccgggcagggtgcccaaaccgttggaatgggggcagaagctcagagtggtccagcagctaccaaatttgtccaccaggcaaatggaatccttggatatgacctgcgtgatcctttgcaccaatggaccaaagaaaagcttgactcaacaatgatcagtcagccagctatatatgtcaccagccttgcagcagtagaggtactacgtgcacgcgaatgaaggccagatgtgattaactctgtagatgttacatgtggtctcagtttggggagagtataccgctcttgcattggccggtgcttatag

SEQ ID NO: 36350 - protein, 141 aa, Zea mays
  misc_feature: Ceres CLONE 1419863-F
  misc_feature: SWISSPROT Homolog: EC 2.3.1.39 [Acyl-carrier-protein] S-malonyltransferase
  misc_feature (62)..(62): Xaa is any aa, unknown, or other
MASMLAILRPSAPAPLAGRRARAAAPATARVALSTRSRYSSARVSLGSEVAVGADALFADYXPTTAFLFPGQGAQTVGMGAEAQSGPAATKFVHQANGILGYDLRDPLHQWTKEKLDSTMISQPAIYVTSLAAVEVLRARE

SEQ ID NO: 36351 - DNA, 623 bp, Zea mays
  misc_feature: Ceres CLONE 1419872-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctggactccccgcggtggcggccgctctagaactagtggatcccccgggctgcaggattcgcacgagaccattacctagaacatcctaatcgaaaaaaattctattactagctgcaaaagggcgtgtttgagactagcggaccgacttgaaagtgaagtgaaaaggcggcctgcgcggcgatggatgtcaagtggccgcctctggaggggaagttgccattcgtgaacggctcccacaatgggggatcgggcctccccatcgcccaaaggccctgggttttgggagggggcgccccccccttttttaaatttcccccnnnncccccccaaaaggaaaaaaaaaacggaaaaaacacccccttttagaaaaggggccccccccccaggnnnnnnnnccggggggggggtttcccccccc

SEQ ID NO: 36352 - DNA, 629 bp, Zea mays
  misc_feature: Ceres CLONE 1419874-F
  misc_feature: Encodes the peptide sequence at SEQ ID NO. 36353
  misc_feature (368)..(368): n is a, c, t, g, unknown, or other
  misc_feature (372)..(372): n is a, c, t, g, unknown, or other
  misc_feature (373)..(373): n is a, c, t, g, unknown, or other
  misc_feature (375)..(375): n is a, c, t, g, unknown, or other
agagctggagctccccgcggtggcggccgctctagaactagtggatcccccgggctgcaggaattcgcacgagaccattacctagaacatcctaatagaaaaacactgatggccccgccagatccaagccgcgacccagacggcaagatagagcgagcgacctctcgattctccccatcccgccgtgcttcccgtcttcaccaaatccttcgccacgatggcgcgcctgctcatccccctccccttcgccgccgcctctgcctcatcgctccacctcgccgtctcccgccttcctctcgccgcggtctccgccgcgcgtcgcgagtgtctctttgggggaagggtggtaggaggaagtggtgagggcncccnncnaggctttctaagcgcgggttgtgcgccggcgcaaaagctggcgactccggccgtcacgggtggaaggccaatggaaatggggcaaagaaaggaaaagaggaggccccctttcccccgttttgtttaacccgggtggggggggacccctccaaaaaaaagattaaaaaattttttcccccccaaagagcccccccccggggaagaaaaaaaaaaaatttttttagaaaaaaaaaggaaagagacacccctctcta

SEQ ID NO: 36353 - protein, 94 aa, Zea mays
  misc_feature: Ceres CLONE 1419874-F
  misc_feature (51)..(51): Xaa is any aa, unknown, or other
  misc_feature (52)..(52): Xaa is any aa, unknown, or other
  misc_feature (53)..(53): Xaa is any aa, unknown, or other
MARLLIPLPFAAASASSLHLAVSRLPLAAVSAARRECLFGGRVVGGSGEGXXXGFLSAGCAPAQKLATPAVTGGRPMEMGQRKEKRRPPFPRFV

SEQ ID NO: 36354 - DNA, 675 bp, Zea mays
  misc_feature: Ceres CLONE 1419879-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (428)..(428): n is a, c, t, g, unknown, or other
  misc_feature (435)..(435): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctgggactccccgcggtggcggccgctctagactagtggatcccccgggctgcaggaattcgcacgagaccattacctagaacatcctaatcgaaaaaaatctgccaatttgtccgaggcccatctccataaaaccctaatccacggccgcggcatccagccctgcgcccccgcccgcttgctcgcctcacccgcggtcgcggcctcccagtgccagcgccaccgccgcttgtcagcctccccacttgagccctgtcctgagtcaagtgtctctcgtgggcacaggacggctacatcgacctctacgggccctacgatnagggtcntcttcactgctcagggggcaacctggtgcgggacctgcatccctcaagtggggttgagggaaggaaaatgttttccccggaaaactaagggggaaaaggatttgctcaaaaggaacccccaaaaccggggaaattggcgttcccccggaaaggggggggaaacccaaaatttcccgggggaaaaagggtttttttccaaaggttcccgcaaagggggaaaaaacccccggggggggaaaa

SEQ ID NO: 36355 - DNA, 709 bp, Zea mays
  misc_feature: Ceres CLONE 1419880-F
  misc_feature: Encodes the peptide sequence at SEQ ID NO. 36356
atagctggagctccccgcggtggcggccgctctagaactagtggatcccccgggctgcaggaattcgcacgagaccattacctagaacatcctaatcgaaaaatatatgcctattagccatacgccaatgttcgttaaatccataatccacggacacgtcatctaaacctgctgccccgcctgcttgttcgtctccaaccgcggtcgctgtctccagtgtccagcgtcacctgctgttgtcaggctccacctttgagcgtgttcctgagttaagtgtctatcgtggccactggacggttacatctacctccatggcccctagcattatgtccttctcaactgctgaagggacatggagtcccctatctgtgtcggctacgtgaataaaggcacagaaatgctatcccccaccactaaagcggaaaaagatatgctacaaatgaaacgacacacgtggagattgcgaatgacaccaccggtgacgcaaaggagattccacatgacagtgatcattacaccattagcagagcgcaagatacgccagtccgacaagtagacgatactgctttactgccctacaagagcaagcatcatgccatactatagattacatacaccgcaaatgcgaaatcacgataacaagaccctgataagaagaagaacttgaccagattggttgaggaacctattcgtatgcgaacaaaaaaga

SEQ ID NO: 36356 - protein, 67 aa, Zea mays
  misc_feature: Ceres CLONE 1419880-F
MESPICVGYVNKGTEMLSPTTKAEKDMLQMKRHTWRLRMTPPVTQRRFHMTVIITPLAERKIRQSDK

SEQ ID NO: 36357 - DNA, 640 bp, Zea mays
  misc_feature: Ceres CLONE 1419884-F
  misc_feature: Encodes the peptide sequence at SEQ ID NO. 36358
  misc_feature (221)..(221): n is a, c, t, g, unknown, or other
  misc_feature (282)..(282): n is a, c, t, g, unknown, or other
aaagctggagctccccgcggtggcggccgctctagaactagtggatcccccgggctgcaggaattcgcacgagaccattatctagaacatcctaatcgaaaaatctgatgccgtaacacaaggctgaatttttgttcggtctagccgacccgacgatggcgtccagcgacgggaaaccactgccaaccccggcctctgtggggcggcggcggcggcagcancaccgcgccgcccgggcagccgaccacggtagcgtccaaggtgctggacatgggcgcggcngcaatgcagtcgttgccgccccgtgaacaggcgaagcagcacatgttgcacgttccgcctgtacccgcacgacccgaaaacggcaggtggaagacccaccctacgtctcccggctcaaacaaggaatccctcccgtgggccctcctttgacttccaaaaaagccgaaccggggtttcatcgggggtggaaatccatccggggcaaggaaaatcttccactccccctcccccgggaggaccaacggctgtgtggcccccccccccccccaaaaacaaatcagggcccgtgggacaaacccccacctggcggggctttcttgagaaaaggggaaatttgaaccccatggccgcccccctt

SEQ ID NO: 36358 - protein, 53 aa, Zea mays
  misc_feature: Ceres CLONE 1419884-F
MGAAAMQSLPPREQAKQHMLHVPPVPARPENGRWKTHPTSPGSNKESLPWALL

SEQ ID NO: 36359 - DNA, 518 bp, Zea mays
  misc_feature: Ceres CLONE 1419890-F
  misc_feature: Pfam Name: Palm_thioest Pfam Description: Palmitoyl protein thioesterase
  misc_feature (284)..(284): n is a, c, t, g, unknown, or other
  misc_feature (396)..(396): n is a, c, t, g, unknown, or other
  misc_feature (397)..(397): n is a, c, t, g, unknown, or other
aaagctggagctccccgcggtggcggccgctctagaactagtggatcccccgggctgcaggaattcgcacgagaccattacctagaacatcctaatcgaaaagctaactagaataggaatccgacgtcgcccccgcccccccctgtgaaaattcgtgatgcggagaacagctaccgccgccctcgtcctcgtccccctcctcgctgcggcggtacagacctccgccctgcctttcatcgtcctgcacgggattggggaccagtgcgtcaaccatgggcgtgccnagttcactaaacttctcgccgattggtccgggttccaaaggtttatggccttaaaaattgggaaaaaaaaaaaagggggggccctttggggggggggggcccccccctttcnnaccccggggggtttttttttccccccgggggggggaaaaaaaacccgggggggggggcccccaattttttttttccccagggaaatttttttgtttaaaccgtttttttttttttttattt

SEQ ID NO: 36360 - DNA, 732 bp, Zea mays
  misc_feature: Ceres CLONE 1419892-F
  misc_feature: Encodes the peptide sequence at SEQ ID NO. 36361
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (89)..(89): n is a, c, t, g, unknown, or other
  misc_feature (100)..(100): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (124)..(124): n is a, c, t, g, unknown, or other
  misc_feature (132)..(132): n is a, c, t, g, unknown, or other
  misc_feature (146)..(146): n is a, c, t, g, unknown, or other
  misc_feature (155)..(155): n is a, c, t, g, unknown, or other
  misc_feature (161)..(161): n is a, c, t, g, unknown, or other
  misc_feature (195)..(195): n is a, c, t, g, unknown, or other
ggggnnnnnnnnnnnnnnnnggggggnnnnnnnnnnnnnnnnnnnnnggggggnnnnnnnnnnncggggggggcggggggggggggggnccaaaactggnagctccacgcgtgcggaggnnngntctttccntttacgcctgcccntgggggggnaggaanttccccatagaaagggcgggagaacatcctaatncgaaaaagtagtaaaaccaggtaggtgtggctcggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggccaggaggattacagcaggttgaggggggggagctacaggggtgccgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcagataggcgc

SEQ ID NO: 36361 - protein, 158 aa, Zea mays
  misc_feature: Ceres CLONE 1419892-F
  misc_feature (15)..(158): Pfam Name: Ras Pfam Description: Ras family
  misc_feature (15)..(128): Pfam Name: Miro Pfam Description: Miro-like protein
MSAAAAASSVTKFIKCVTVGDGAVGKTCMLICYTCNKFPTDYIPTVFDNFSANVSVGGSIVNLGLWDTAGQEDYSRLRGGSYRGADVFILSFSLVSRASYENVLKKWMPELRRFSPTVPVVLVGTKLDLREDRSYLADHSAASIISTEQGEELRKQIG

SEQ ID NO: 36362 - DNA, 636 bp, Zea mays
  misc_feature: Ceres CLONE 1419893-F
  misc_feature: Encodes the peptide sequence at SEQ ID NO. 36363
ggagctccccgcggtggcggccgctctagaactagtggatcccccgggctgcaggaattcgcacgagaccattacctagaacatcctaatcgaaaaagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagaggtccgtaccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactccaactgcgcgaggaagccatcctgatatctctgtcgtctccccatcctagtagcgtagaaacacctgcattttcattttgatcttcctaatccctccgctagctgctttccagtgacccaaagatttcagagaacacctcccggcttcctcccgtgggctggctgtctcttggtcttaaaacaatggc

SEQ ID NO: 36363 - protein, 51 aa, Zea mays; identical to SEQ ID NO: 13325
  misc_feature: Ceres CLONE 1419893-F
  misc_feature (1)..(51): Pfam Name: AdoMetDC_leader Pfam Description: S-adenosyl-l-methionine decarboxylase leader peptide

SEQ ID NO: 36364 - DNA, 686 bp, Zea mays
  misc_feature: Ceres CLONE 1419897-F
  misc_feature: Encodes the peptide sequence at SEQ ID NO. 36365
ctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccagagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcct

SEQ ID NO: 36365 - protein, 153 aa, Zea mays
  misc_feature: Ceres CLONE 1419897-F
  misc_feature (49)..(153): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLL

SEQ ID NO: 36366 - DNA, 691 bp, Zea mays
  misc_feature: Ceres CLONE 1419898-F
  misc_feature: Encodes the peptide sequence at SEQ ID NO. 36367
ctggagctccccgcggtggcggccgctctagaactagtggatcccccgggctgcaggaattcgcacgagaccattacctagaacatcctaatcgaaaacttcaaaaatcaagttgattatgcggataccgcaaacactgcaaattcggttgttccctacccttctagagtaatctctccacacacacactcacacgctgctgccggctgccctcctcccgccccactcgtcccctccgaaccaagtccgatccatccatccccaaatttctcctctcagcgcgtggggcagtggcggcggcagcgtgggcgcgcggaccgctacgggcacgggagcagcggtggctgcgcaagcagctgtcagcatgcggcatggtgactacgggagcccaggcggcgccggtgcggctgcagccggcggcgggcgaccgtgaggcggctgcgggagcggtgaagtccggtggcgcctgctttgttttgtgttcctatttttgatttgcgaaaggatccaagagagagaggagggggagaaggcgagaatccaagacaagagcgagcatggagtttgctactggtgccatgggtaccctcctccccaagctgggcatgctgctgcaggaagaactccacctgaagaataatgtgaaggaggggatcaagagcctcactgccgagcttgagagcatgcatcc

SEQ ID NO: 36367 - protein, 44 aa, Zea mays
  misc_feature: Ceres CLONE 1419898-F
MEFATGAMGTLLPKLGMLLQEELHLKNNVKEGIKSLTAELESMH

SEQ ID NO: 36368 - DNA, 587 bp, Zea mays
  misc_feature: Ceres CLONE 1419918-F
  misc_feature: Encodes the peptide sequence at SEQ ID NO. 36369
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttcaagctggactcccgcggtggcggccgctctagaactagtggatcccccgggctgcaggattcgcacgagaccattacctagaacatcctaatcgaaaaaccccagccgccgccgccgccaccgccaccgccaccgccacctgccccagcgcgccgccgccgcagccaccatgggtcgcgtccgcaccaagaccgtgaagaaagacctccagcaggtgatcgagaagtactactcccgcatgaccctcgacttccacaacaacaaaaaagtgcctggaggaggtcttgatttctgcccctcgaaaccccctcccccaaaaaaggggggggggggtttcccaatacccccccctggaagggccccgcaaatccaaggggggggccccaaattccccggggggattttcccccctccaaaaaag

SEQ ID NO: 36369 - protein, 84 aa, Zea mays
  misc_feature: Ceres CLONE 1419918-F
MGRVRTKTVKKDLQQVIEKYYSRMTLDFHNNKKVPGGGLDFCPSKPPPPKKGGGGFPIPPPGRAPQIQGGGPKFPGGIFPPPKK

SEQ ID NO: 36370 - DNA, 733 bp, Zea mays
  misc_feature: Ceres CLONE 1419924-F
  misc_feature: Encodes the peptide sequence at SEQ ID NO. 36371
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (104)..(104): n is a, c, t, g, unknown, or other
  misc_feature (421)..(421): n is a, c, t, g, unknown, or other
  misc_feature (428)..(428): n is a, c, t, g, unknown, or other
  misc_feature (435)..(435): n is a, c, t, g, unknown, or other
  misc_feature (443)..(443): n is a, c, t, g, unknown, or other
  misc_feature (444)..(444): n is a, c, t, g, unknown, or other
  misc_feature (465)..(465): n is a, c, t, g, unknown, or other
  misc_feature (468)..(468): n is a, c, t, g, unknown, or other
  misc_feature (477)..(477): n is a, c, t, g, unknown, or other
  misc_feature (484)..(484): n is a, c, t, g, unknown, or other
  misc_feature (520)..(520): n is a, c, t, g, unknown, or other
  misc_feature (521)..(521): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaangggaactccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggcctggnccctggncgtgtcnaccgccgnnagcgagggacatcagaccccnacnaccgaaaanaaggacnacaccgttgtggcaccccaaaacttcccggcctttnngacgccttcggggggggggcggtccccgggggttggggggcctttccggggggggagaattcccgggaagcagaatttcccggggttaaaaatgccccgggaacggggaaaaacccttacccggggtaaaactttgccccgggaaagggaaaaatgccccctctttttggggggggggttcccccggggttttaagggggtttttggggggg

SEQ ID NO: 36371 - protein, 120 aa, Zea mays
  misc_feature: Ceres CLONE 1419924-F
  misc_feature (17)..(17): Xaa is any aa, unknown, or other
  misc_feature (19)..(19): Xaa is any aa, unknown, or other
  misc_feature (24)..(24): Xaa is any aa, unknown, or other
  misc_feature (35)..(35): Xaa is any aa, unknown, or other
  misc_feature (38)..(38): Xaa is any aa, unknown, or other
  misc_feature (50)..(50): Xaa is any aa, unknown, or other
MARSSKMMVAAALLAWXLXVSTAXSEGHQTPTTEXKDXTVVAPQNFPAFXTPSGGGRSPGVGGPFRGGRIPGKQNFPGLKMPRERGKTLTRGKTLPREREKCPLFLGGGFPRGFKGVFGG

SEQ ID NO: 36372 - DNA, 706 bp, Zea mays
  misc_feature: Ceres CLONE 1419931-F
  misc_feature: Encodes the peptide sequence at SEQ ID NO. 36373
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (323)..(323): n is a, c, t, g, unknown, or other
  misc_feature (331)..(331): n is a, c, t, g, unknown, or other
  misc_feature (340)..(340): n is a, c, t, g, unknown, or other
  misc_feature (341)..(341): n is a, c, t, g, unknown, or other
  misc_feature (353)..(353): n is a, c, t, g, unknown, or other
  misc_feature (395)..(395): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagctggagctccccgcggtggcggccgctctagaactagtggatcccccgggctgcaggaattcgcacgagaccattacctagaacatcataatcgaaaaatcaaccatattattgagaccaacaagcaacatagaaagtggaatccagtagcaacaacagagcaacaatggcgaccaagatattttccctccttatgctccntgctcttnctgcatgtnngtgctacgcgancattttcccctcatgctcacaagctcctatagcttcccttcntcccccatacctttcaatcatgatagcttcaggatgtgaaaaccccagttcttcagccctaaaggcttcaacaaggaatcccagcaaggaacttacctttataccctttgttgtttttaaaaatcccccagccttattttttgggggcctccattggggacaaacacttagggggaaaaaaggtttggaaaaattcggggttccctggggaataaccaaaaaggtctttgggaaaaattttttccccctccttttaaaaaaaaaaattttttttcctttttaaacacatggttttaaccgaagacccccgg

SEQ ID NO: 36373 - protein, 129 aa, Zea mays
  misc_feature: Ceres CLONE 1419931-F
  misc_feature (12)..(12): Xaa is any aa, unknown, or other
  misc_feature (15)..(15): Xaa is any aa, unknown, or other
  misc_feature (18)..(18): Xaa is any aa, unknown, or other
  misc_feature (22)..(22): Xaa is any aa, unknown, or other
  misc_feature (36)..(36): Xaa is any aa, unknown, or other
MATKIFSLLMLXALXACXCYAXIFPSCSQAPIASLXPPYLSIMIASGCENPSSSALKASTRNPSKELTFIPFVVFKNPPALFFGGLHWGQTLRGKKGLEKFGVPWGITKKVFGKNFFPLLLKKKIFFPF

SEQ ID NO: 36374 - DNA, 745 bp, Zea mays
  misc_feature: Ceres CLONE 1419933-F
  misc_feature: Encodes the peptide sequence at SEQ ID NO. 36375
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (53)..(53): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (74)..(74): n is a, c, t, g, unknown, or other
  misc_feature (75)..(75): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (114)..(114): n is a, c, t, g, unknown, or other
  misc_feature (115)..(115): n is a, c, t, g, unknown, or other
  misc_feature (117)..(117): n is a, c, t, g, unknown, or other
  misc_feature (118)..(118): n is a, c, t, g, unknown, or other
  misc_feature (120)..(120): n is a, c, t, g, unknown, or other
ggggggggggngnnnnngggccacgcccccaccccagnnncccgccggggganactnnnnntttgggggggggnnggggggnnnnttcaaagctggactccccgcggtggcggnngnncngttcttcaccgacccccgggctgcaggaattcccacgagacgattagcgagaacatcctaatcgaaaatcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctgtctccctctccgcggaaccacgagagccgggccgtggcgcctgcggtggtgttcaccccgcccccgccgcctgcttctgtgaatgtcgcgctgccgcccgtgcaagggccccccgccgcagaacgagaaggggtcccgccgggggcaagcatggaagaaacggcggtcgggtttcttctgggaacccccgcgcgcgccgcccaggaagcgcaacccaagcctccaacaagaaaccggcctaccccggttccggtgtggaaacaacc

SEQ ID NO: 36375 - protein, 61 aa, Zea mays
  misc_feature: Ceres CLONE 1419933-F
MSRCRPCKGPPPQNEKGSRRGQAWKKRRSGFFWEPPRAPPRKRNPSLQQETGLPRFRCGNN

SEQ ID NO: 36376 - DNA, 683 bp, Zea mays
  misc_feature: Ceres CLONE 1419935-F
  misc_feature: Encodes the peptide sequence at SEQ ID NO. 36377
  misc_feature (290)..(290): n is a, c, t, g, unknown, or other
aaagctggagctccccgcggtggcggccgctctagaactagtggatcccccgggctgcaggaattcgcacgagaccattacctagaacatcctaatcgaaaagtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcgagggttgcaagaagaaggtgaagaangtgctccacagcatagaaggggtgtacaagacggacatagacacgcagcagcagaaggtggtggtcataggcaacgtctctgcagacgcgctcgtcaagaagctccctcagtccggggaagcacgcggagccctggccggagcctgctccacccccaccgggccgcgaaagccccgccggggccccaaggattttccgggagcgccagggaaaaaaaaaaaaaaaaaaaaaggggaaaaaaaaccccaaggggggaaaaaaaaaacccccccaaatcggggccaaggcccccccccccccccggggaggggaaaggggaaccccacccccccaaaaaacaacaaaaggtaaaggggggccccctgggggaagagaccttagggggggaagaaa

SEQ ID NO: 36377 - protein, 149 aa, Zea mays
  misc_feature: Ceres CLONE 1419935-F
  misc_feature (17)..(88): Pfam Name: HMA Pfam Description: Heavy-metal-associated domain
  misc_feature (33)..(33): Xaa is any aa, unknown, or other
MAAAEEGPEPLRYQTLALRVSIHCEGCKKKVKXVLHSIEGVYKTDIDTQQQKVVVIGNVSADALVKKLPQSGEARGALAGACSTPTGPRKPRRGPKDFPGAPGKKKKKKKGEKKPQGGKKKTPPNRGQGPPPPPGRGKGNPTPPKNNKR

SEQ ID NO: 36378 - DNA, 512 bp, Zea mays
  misc_feature: Ceres CLONE 1419938-F
  misc_feature (245)..(245): n is a, c, t, g, unknown, or other
  misc_feature (255)..(255): n is a, c, t, g, unknown, or other
  misc_feature (259)..(259): n is a, c, t, g, unknown, or other
  misc_feature (262)..(262): n is a, c, t, g, unknown, or other
  misc_feature (337)..(337): n is a, c, t, g, unknown, or other
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcaacgggagggtggcggggggctacnggcgaacctnccancgncggggcggcatgcacgcaagcgccacacacgaagcaggccgcatgatacgggctcaggcccaaagccccaacttngggggtcaatctgggctttcgggcttatctggcgggcccgaaacccccccggggggcccccccggctggggaatctaccccggtttgggggccgcccccctcccctgggggcctggggggggggggttttcacccccccgggggcgccccggggcctcccccctatttgggtttt

SEQ ID NO: 36379 - DNA, 833 bp, Zea mays
  misc_feature: Ceres CLONE 1419942-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (482)..(482): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnccccnnnnnnnnnnnnnnnnnnnnnnnnnnnnnnnnnnnnnnnnnnnnnnnnnnnnnnnnnnnnnnccaaactgggactccaccgcggtggcggccgctctagaactagtggatcccccgggctgcaggaattcgcacgagaccattacctagaacatcctaatcgaaaaatcaaatcagatcagcaaagcggcagtgcgtagagaggatcgtcgaacagaacagcatgaagatggtcatcgntctcgtcgtgtgcctggctctgtcagctgccagcggcctctgcaatgaaaatgccctgccccctgccccggggctccaagggtttgtaaaggggctttgggccccggcccttaaaaaaaaaaaaaagggggccccggggggggttttagcccccccccccggggaaaaacccttgaggggggcccccccaaggggggacccccccccctggggggggggggggcgcccccataaaaaacgccgggggggggggggggaaaaaaaaaccccttttttttcaccccccccccccaaaaaaaggggggtccccccccccaaaaaaaaaaaaagaggagggggggcgcgcccccc

SEQ ID NO: 36380 - DNA, 668 bp, Zea mays
  misc_feature: Ceres CLONE 1419946-F
  misc_feature: Encodes the peptide sequence at SEQ ID NO. 36381
  misc_feature (613)..(613): n is a, c, t, g, unknown, or other
gctctagaactagtggatcccccgggctgcaggaattcgcacgagaccattacctagaacatcctaatcgaaaaatgctcttcgccccctcgcgcttaccgctgccgcgcctcccgactcgccgcctccgcctagctccgggctctccaatggcctccatgctcgccatcctcaggccctcggcgccggccccgctcgcgggacgccgggccagggctgccgcgccggcgaccgcgagggtggcgctatctaccagatctaggtattcgtcagccagggtgtcgctcggctccgaggttgcagtgggcgccgacgcgctcttcgccgactataagcccaccaccgctttcctcttccccggccagggtgcccaaaccgttggaatgggggcagaagctcagagtgttccagcagctaccaaattgttcaaccaggcaaatgacatccttggatatgacttgctggatctttgcaccaatggaccaaaagaaaagcttgactcaacaatgatcagtcagccagctatatatgtcaccagccttgcagcaatagaggtactacctgccccgcgatggaggcccaaatgtgaataactcctgtagatgttacctgnggtctcaaatggggaaaagaaaacccctcttgcatttgcccgttccttttaactg

SEQ ID NO: 36381 - protein, 147 aa, Zea mays
  misc_feature: Ceres CLONE 1419946-F
  misc_feature: SWISSPROT Homolog: EC 2.3.1.39 [Acyl-carrier-protein] S-malonyltransferase
MASMLAILRPSAPAPLAGRRARAAAPATARVALSTRSRYSSARVSLGSEVAVGADALFADYKPTTAFLFPGQGAQTVGMGAEAQSVPAATKLFNQANDILGYDLLDLCTNGPKEKLDSTMISQPAIYVTSLAAIEVLPAPRWRPKCE

SEQ ID NO: 36382 - DNA, 590 bp, Zea mays
  misc_feature: Ceres CLONE 1419954-F
  misc_feature: Translation starting site: 279
  misc_feature (409)..(409): n is a, c, t, g, unknown, or other
  misc_feature (410)..(410): n is a, c, t, g, unknown, or other
  misc_feature (418)..(418): n is a, c, t, g, unknown, or other
  misc_feature (429)..(429): n is a, c, t, g, unknown, or other
  misc_feature (558)..(558): n is a, c, t, g, unknown, or other
  misc_feature (559)..(559): n is a, c, t, g, unknown, or other
  misc_feature (562)..(562): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaaattagttcagcacagcacatcttcctcgcagcgccggcgctccatcttccgctccctcccccaccttcgatcggcacgcaggctcggcgtcgtcgtcagcggttcctcctcccgcctctcgccagtagcctcgcgccctcgccgactggcgaccctgccttgaaggggctggcaagatgatcggcgtagggaaggcgaagcagtacgccaacgtccttgacaagcccctcagccgtggcagggcaggaggtcagtttgagtgcatttgcattcttgttctctgaagtgggtcagtacaaccagactnncagtgacnacattactganctgggaaacgagctggaggatgcctgttatgctgtttgtggcaagggtgcttgaaactatcctgtccccgggaagaagggaaatagaccaaggaacgacattctggggttttttatctttcatccccgnnttnntttttttttgaaaaaaggtgtttttga

SEQ ID NO: 36383 - DNA, 637 bp, Zea mays
  misc_feature: Ceres CLONE 1419955-F
  misc_feature: Encodes the peptide sequence at SEQ ID NO. 36384
  misc_feature (637)..(637): n is a, c, t, g, unknown, or other
ggagctccccgcggtggcggccgctctagaactagtggatcccccgggctgcaggaattcgcacgagaccattacctagaacatcctaatagaaaaaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcgtctcctccatcgagcagaaggaggagggtccaggcaatgaggaccgtgtaacactcatcaaggactaccgtggcaagattgaaactgagctcaccaagatctgtggatgcatcctcaagcttctcgaatctcaccttgtgccgccttcccccgctcccgagtcaaggtcttccatctcaagatgaagggggactactacagaaaccttgcttaatgttaaaactggagcttaaaaaaaggaccctgccgaaaaccccn

SEQ ID NO: 36384 - protein, 129 aa, Zea mays
  misc_feature: Ceres CLONE 1419955-F
  misc_feature (8)..(130): Pfam Name: 14-3-3 Pfam Description: 14-3-3 protein
MASAELSREENVYMAKLAEQAERYEEMVEFMEKVAKTVDSEELTVEERNLLSVAYKNVIGARRASWRIVSSIEQKEEGPGNEDRVTLIKDYRGKIETELTKICGCILKLLESHLVPPSPAPESRSSISR

SEQ ID NO: 36385 - DNA, 702 bp, Zea mays
  misc_feature: Ceres CLONE 1419966-F
  misc_feature: Encodes the peptide sequence at SEQ ID NO. 36386
  misc_feature (313)..(313): n is a, c, t, g, unknown, or other
  misc_feature (335)..(335): n is a, c, t, g, unknown, or other
aaaaagctggagctccccgcggtggcggccgctctagaactagtggatcccccgggctgcaggaattcgcacgagaccattacctagaacatcctaatcgaaaaccgcctcccaccacctcgccattctccccctcccgcgccccgagaagcgctgcgggcctcacctgcccgtcctcctgcctctcaggaaccgcggttcaggaaggaagggaaggcaagtgcctgccggggctcagcaccgatggcgtacagggcggaagacgactacgactacctctttcaggtcgttctcatcggcgactctggcgtcnggcaaatccacctgctcttcangttcacgcgcaacgagttcagcctagaagtcaagtcccaccatcggggtcgagtttgctaccaagagcatccgggtcgaaccaacaagtcgtctagggcccgatcttgggacactgcttgcccaggagaggtttcgggcaaataccaagtgcgtactatagagggggctgtttggaacccttttccccgtatgaaattgacacccccctgtgaactttttagaatagtggagaaggtggggtaaaaggaactccccgaattcacctgatgccaaaacttggtctcctagctttggtgggcaaaaaaacttgattttgcaacccctttaagactttatcccggggaggaaccccaaaggccttccccc

SEQ ID NO: 36386 - protein, 111 aa, Zea mays
  misc_feature: Ceres CLONE 1419966-F
  misc_feature (24)..(24): Xaa is any aa, unknown, or other
  misc_feature (31)..(31): Xaa is any aa, unknown, or other
MAYRAEDDYDYLFQVVLIGDSGVXQIHLLFXFTRNEFSLEVKSHHRGRVCYQEHPGRTNKSSRARSWDTACPGEVSGKYQVRTIEGAVWNPFPRMKLTPPCELFRIVEKVG

SEQ ID NO: 36387 - DNA, 705 bp, Zea mays
  misc_feature: Ceres CLONE 1419967-F
  misc_feature: Encodes the peptide sequence at SEQ ID NO. 36388
  misc_feature (523)..(523): n is a, c, t, g, unknown, or other
  misc_feature (544)..(544): n is a, c, t, g, unknown, or other
agagctggagctccccgcggtggcggccgctctagaactagtggatcccccgggctgcaggaattcgcacgagaccattacctagaacatcctaatcgaaaaatcgaaaacccaccgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtcttcggcccggcggcggtggaccccaagctggccgcctggtggcgcgccggacgccggccgcggatgctgcaggaggcacggtgctggaccagaanggtgtggttccgcccgctcgnagacgtcgagaagccgccccccgccgcgtgagccgccgcgcgctgctaagccagcccacactgctgctcgctcataaaaaggcgggcgggagagcctggcagtggcaagcactctgctcgtgctcgggcgggctgggctcccggctaaatcactgcatatt

SEQ ID NO: 36388 - protein, 121 aa, Zea mays
  misc_feature: Ceres CLONE 1419967-F
  misc_feature (105)..(105): Xaa is any aa, unknown, or other
  misc_feature (112)..(112): Xaa is any aa, unknown, or other
MAAAAGSKGRAIAGSFVSRVLAGKAASPRRAVHASAYDKNLEDQVRPAFVPDDVIGSAGSPDKYWSPHPKTGVFGPAAVDPKLAAWWRAGRRPRMLQEARCWTRXVWFRPLXDVEKPPPAA

SEQ ID NO: 36389 - DNA, 715 bp, Zea mays
  misc_feature: Ceres CLONE 1419972-F
aagctggagctccccgcggtggcggccgctctagaactagtggatcccccgggctgcaggaattcgcacgagaccattacctagaacatcctaatcgaaaaactcttgtaattgtctcgatctttcactctcatttctatctcccaccgtagaaatttaaagtaataaaaattatttatatataaatatatcatcttcttaaatatacatcacattaatacattattacaaatttaaattttacaaaggagtcgagaagaagaagcatatgagaaagcgtcaagtggtgttgaggagagcctcgccggaggaaccttctagaagctcgtcgacggcttcgtctctgacggtgagaggtgtgagatacggcgagtgtcagaagaaccatgcggcggcggtcggcggatacgccgtcgatggctgccgtgagttcatggcaagcaacggagaggaaggttcggtggcagcgctaacgtgcgccgcctgtggctgccaccgcagtttccatcgtagagaaatcgaaaccgaggttgtttgcgactgtaattcacctccttcgactggaaactagaccagtaaaaactagacctaggtaagagttaatctgggtgtgtctttgtgtgctatatattatactataatacacggctgaaattcttaaaatatatatattatattgttttaataccttcgtagtgtcaagggtttgtgtctc

SEQ ID NO: 36390 - DNA, 624 bp, Zea mays
  misc_feature: Ceres CLONE 1419974-F
  misc_feature (11)..(11): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (135)..(135): n is a, c, t, g, unknown, or other
  misc_feature (430)..(430): n is a, c, t, g, unknown, or other
  misc_feature (431)..(431): n is a, c, t, g, unknown, or other
  misc_feature (507)..(507): n is a, c, t, g, unknown, or other
  misc_feature (545)..(545): n is a, c, t, g, unknown, or other
  misc_feature (559)..(559): n is a, c, t, g, unknown, or other
  misc_feature (573)..(573): n is a, c, t, g, unknown, or other
  misc_feature (574)..(574): n is a, c, t, g, unknown, or other
  misc_feature (583)..(583): n is a, c, t, g, unknown, or other
  misc_feature (609)..(609): n is a, c, t, g, unknown, or other
aaaaaaaaaanaaaaaatatatatantnnttttgggtgggtggaaggtagggccacgcgggggggagccgatctgtttgctcctcccaaaaggaggggnnnnnnnnnnnnnnnnnnccaggctgggactcaccgncggtggcggccgctctagaatagtggatcccccgggctgcaggaattcgcacgagaccattacctagaacatcctaatcgaaatcctttctccgggcacaccatactgttcttgctacttctagatagaggaaacagagagagaggccaccgacatcgccctcttaaccgacaagcccccattgcccaggaagaccccgtggccggggaagcaaacccccgcgcattccccccgtccccgggggcccccggggaacccggggggaaaagggaggggaaacccccccgggtggggnnggggggttttttttcttctccttcccgccggaggggggggaaaccccccccccccccccccccgggttttttttgnttggggggggagagaaagaccctccctcccgccccccncccccccccccccncccaaaaacacttnnttaaataanaatatattggtgggggggggcggccncgcgggccgttttcc

SEQ ID NO: 36391 - DNA, 632 bp, Zea mays
  misc_feature: Ceres CLONE 1419984-F
  misc_feature (410)..(410): n is a, c, t, g, unknown, or other
  misc_feature (411)..(411): n is a, c, t, g, unknown, or other
  misc_feature (424)..(424): n is a, c, t, g, unknown, or other
aaagctggagctccccgcggtggcggccgctctagaactagtggatcccccgggctgcaggaattcgcacgagaccattaactagaacatcctaatcgaaaaattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcaccctttgtccctccaacatcatcagccctattacaacagttacccttggnntgcatttattggncacaaacattcagggcacaacaactacaacaacttgtgctagcaaaccttgctgcctactttcaagcaacggcagtttcttccatccaaccaactaggtcattgaaactctgcctcttattttgaaaaaacaacaacttacatttcaggcaggtaccttggtgcctaccccccagaaatttcttccattcaaccaacttagcgggttt

SEQ ID NO: 36392 - DNA, 636 bp, Zea mays
  misc_feature: Ceres CLONE 1419988-F
  misc_feature: Translation starting site: 147
  misc_feature (403)..(403): n is a, c, t, g, unknown, or other
  misc_feature (440)..(440): n is a, c, t, g, unknown, or other
  misc_feature (441)..(441): n is a, c, t, g, unknown, or other
aaaaagctggagctccccgcggtggcggccgctctagaactagtggatcccccgggctgcaggaattcgcacgagaccattacctagaacatcctaatcgaaaaaggagaggggagcgagcgagcgagcaaccggcggcgacagccatggcggagcagcacaaggaggagtcgggcgtgacagtgctggacaagatctccgacaagctccacgggcgagggggcggctcgtcctcgtcgtcggactcggacgacgagcgctcgtcggcgacggccgccgtgaaggccaagatctaccgcatcttcgggcgcgagaagcctgtgcactccgtcctcggcggcggcaagccggccgatctgtttctatggaggaaaacagagatctctggatggggtgctcgcangcgcaactgccttctggctgctgtttgaggtcatggnnatacaccctctcaccctgctaatgcactgccttcatctcaccctgggcatccctgtcctcttgtcccaatgcacgactttcatcaacaagtctccctcctacatccccgaagggaaaaatcccgaagaacctggctggtaaaggttgcacgttccctggaaaatgaaatccaccggggttttcgctacttgaggg

SEQ ID NO: 36393 - DNA, 827 bp, Zea mays
  misc_feature: Ceres CLONE 1420013-F
  misc_feature: Encodes the peptide sequence at SEQ ID NO. 36394
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (27)..(27): n is a, c, t, g, unknown, or other
  misc_feature (35)..(35): n is a, c, t, g, unknown, or other
  misc_feature (41)..(41): n is a, c, t, g, unknown, or other
ncccccccccnnnnnnnaaccccgtgngggggggngtaaangggcaaactggagctccccgcggtggcggccgctctagactagtggatcccccgggctgcaggaattcgcacgagaccattacctagaacatcctaatcgaaaaaacattccttcgtctttgctcgaggagtcgaggttcatgttccacggtgcagctagagctggttcgcattcttcgacagtaagagcccatggtcgctgcggctgctaatttgctgcgcgcgcatggtggccatcgcgcttctcccccaacatggaggccacgccggcttggttcgtggcgacgtctggttcagctccagaaccccccggttcctcctcgacgaagacggacgcctcctgggctgctcctcgggcaggccaggccgactacatttccggcccccaatgtgcggtggtgccactcccggctccgggaggcctcccccccctcgatctgcaagaggacggttaccgcagccccacctggggggaaaccggaggcgatcccgccttgtttttttccttctccccggagggtgcttcctctgtgcggtcggtgagcccccccctccccggggctcccctcgggggagcggggcaccacgctgggcgcgtttctgttaggctcttggggtggacggggccgggggggggcccgagtctgggggcggaaattgcccctccgtgcctccttactacggttggtgggaggtcctttgtggtgcggggagggtcggaatgcatttcacctaatgttttttgagttgtttctatgttaacttgtgcgagtctcctaggggggg

SEQ ID NO: 36394 - protein, 163 aa, Zea mays
  misc_feature: Ceres CLONE 1420013-F
MEATPAWFVATSGSAPEPPGSSSTKTDASWAAPRAGQADYISGPQCAVVPLPAPGGLPPLDLQEDGYRSPTWGETGGDPALFFSFSPEGASSVRSVSPPLPGAPLGGAGHHAGRVSVRLLGWTGPGGGPSLGAEIAPPCLLTTVGGRSFVVRGGSECISPNVF

SEQ ID NO: 36395 - DNA, 622 bp, Zea mays
  misc_feature: Ceres CLONE 1420015-F
  misc_feature: Encodes the peptide sequence at SEQ ID NO. 36396
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaaaccatttcgctagctccatagcacttgttccagctagctaggagagagagctttgtttaggtaatttagctttgtgtatatcttcttggttctagctctttgaaattttttttatctgggtgcaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccttggtgactggtactgctcctgcggcgcacacaacttcgccagccgcntcaactgcttcaggtgctctgcctacaaggaggaggctgccggcgcctttgatagtgacatgtcacgctcacgcggctacgccggcttcggcagcggcgctgccgcccgtacaaccgccccggttggaagtctggagactggatctgcc

SEQ ID NO: 36396 - protein, 128 aa, Zea mays
  misc_feature: Ceres CLONE 1420015-F
  misc_feature (62)..(90): Pfam Name: zf-RanBP Pfam Description: Zn-finger in Ran binding protein and others
  misc_feature (4)..(33): Pfam Name: zf-RanBP Pfam Description: Zn-finger in Ran binding protein and others
  misc_feature (79)..(79): Xaa is any aa, unknown, or other
MNRKPGDWDCRACQHLNFSRRDACQRCSEPRGVGDRSGGGGDLGGRGGSSFGGGFGAGSDVRLGDWYCSCGAHNFASRXNCFRCSAYKEEAAGAFDSDMSRSRGYAGFGSGAAARTTAPVGSLETGSA

SEQ ID NO: 36397 - DNA, 637 bp, Zea mays
  misc_feature: Ceres CLONE 1420016-F
  misc_feature: Translation starting site: 165
agagctggagctccccgcggtggcggccgctctagaactagtggatcccccgggctgcaggaattcgcacgagaccattacctagaacatcctaatcgaaaaattcggctgctctcgaccgatcggcgccacgagtgctttctggctgggagcctgggagcgccatggggaggtcgccgtgctgcgagaaggcgcacaccaacaagggcgcttggaccaaggaggaggacgagcggctggtggcgtacgtccgggcgcacggcgaggggtgctggcgctcgctgcccaaggcggcggggctgctgcgctgcggcaagagctgcaggctgcgctggatgaactacctccgcccggacctcaagcgcggcaacttcaccgacgacgaggacgagctcatcatccgcctgcacagcctcctgggcaacaagtgagtggtccctcatcgccgggcagctgcctggccggacggacaacgagatcaagaactactggaacacgcacatcaagcgcaagctcctcgcccgcggcatcgacccgaagacgcaccgcccgctcggcgccggcgccgacgccgccgcgccacccggcgtggtcgcgcaccgggcgctgctgcaccgcgcagcccccgtcgagctcg

SEQ ID NO: 36398 - DNA, 621 bp, Zea mays
  misc_feature: Ceres CLONE 1420017-F
  misc_feature: Encodes the peptide sequence at SEQ ID NO. 36399
  misc_feature (269)..(269): n is a, c, t, g, unknown, or other
  misc_feature (299)..(299): n is a, c, t, g, unknown, or other
  misc_feature (335)..(335): n is a, c, t, g, unknown, or other
aaagctggagctccccgcggtggcggccgctctagaactagtggatcccccgggctgcaggaattcgcacgagaccattacctagaacatcctaatcgaaaaacacatacaagtgtcacgtccccggtccctcgcgaaccctagagccgcagcagcacactcccgcagtagcagcagccgccgccgccgccgcccagccgcaggaaacaggaggaagatgccggcggggcacgggcttcggtcgcgaacccgcgaccctgtcgcgcggncgttcccgcagaagggttacatcccgctcnacacgtacctgcgcaccctacagatcggcgactacntcgacgtcaaggtggaacgggcgccctgcaccaagggcatggccgaacaagttcaccacggcccgcaccggtccgtcttgggacgtcaccaagcgcggccttcgggttttaaatcaaccgggcgggttaatgggcccgttcatcgggaaagcgttttccttgtccctgtgggagaatgggcaccccccccttttgaaaaaagaatttccccctgggggaaaccccaaaaacatatccttccagggttaagccccggaacccgtggggggggggtatccccccccaa

SEQ ID NO: 36399 - protein, 134 aa, Zea mays
  misc_feature: Ceres CLONE 1420017-F
  misc_feature (18)..(18): Xaa is any aa, unknown, or other
  misc_feature (28)..(28): Xaa is any aa, unknown, or other
  misc_feature (40)..(40): Xaa is any aa, unknown, or other
MPAGHGLRSRTRDPVARXFPQKGYIPLXTYLRTLQIGDYXDVKVERAPCTKGMAEQVHHGPHRSVLGRHQARPSGFKSTGRVNGPVHRESVFLVPVGEWAPPPFEKRISPWGKPQKHILPGLSPGTRGGGVSPP

SEQ ID NO: 36400 - DNA, 706 bp, Zea mays
  misc_feature: Ceres CLONE 1420018-F
  misc_feature: Encodes the peptide sequence at SEQ ID NO. 36401
  misc_feature (596)..(596): n is a, c, t, g, unknown, or other
  misc_feature (625)..(625): n is a, c, t, g, unknown, or other
aaactggagctccccgcggtggcggccgctctagaactagtggatcccccgggctgcaggaattcgcacgagaccattacctagaacatcctaatcgaaaaaacaacagcagcccccggggccacagggcgcaggcccgcagccatggaccaggaccacaagaggctagtactcccgtcgccggcgccgcagtccccgccggcatccgccgcgtcggcgtcgaccacggcctcgccgtactccgcgctacaccctctcctcttgccctccccgaacccgcacctcttcctgaagcccaagacgctaactctctccctctcgtcctcctccctcacctccatgtcctcctcctcgctgcccgcccccgtcaccgatgtctgggaggtcgtcacccccactgccccatctgttgaccacgtggacggcgggcttgatgactgcgccatcttcccgccgcggctgcatgaggggctgggcctggacggcgagcccgaggaggtcccgccgatgccagcagtggcgaaggaagacaacgaggtagatggtgaataccagggggaggacgatgagtggctgtggggatgggagacgtgcanctttggcgctaggcgcactatgggcgccngtgtcgggatcattcaggagcgggtgctcgtgcaatgcccgtgtgggtgcccgagcgtaaagcccgccgtgtggtcgagtg

SEQ ID NO: 36401 - protein, 187 aa, Zea mays
  misc_feature: Ceres CLONE 1420018-F
  misc_feature (151)..(151): Xaa is any aa, unknown, or other
  misc_feature (161)..(161): Xaa is any aa, unknown, or other
MDQDHKRLVLPSPAPQSPPASAASASTTASPYSALHPLLLPSPNPHLFLKPKTLTLSLSSSSLTSMSSSSLPAPVTDVWEVVTPTAPSVDHVDGGLDDCAIFPPRLHEGLGLDGEPEEVPPMPAVAKEDNEVDGEYQGEDDEWLWGWETCXFGARRTMGAXVGIIQERVLVQCPCGCPSVKPAVWSS

SEQ ID NO: 36402 - DNA, 646 bp, Zea mays
  misc_feature: Ceres CLONE 1420019-F
  misc_feature: Encodes the peptide sequence at SEQ ID NO. 36403
  misc_feature (542)..(542): n is a, c, t, g, unknown, or other
aaagctggagctccccgcggtggcggccgctctagaactagtggatcccccgggctgcaggaattcgcacgagaccattacctagaacatcctaatcgaaaaagatcaggatccattaacacccctacgtacgcctttcctctggaaacccttctctcgcctgcctctcccccgccgcgccgccacttcccctctcccgtcaactccggcttccgcgcgaggtcgagctagcgtttggagttctcgagacctgctgtgatggcgacagagcaagcggcggagaactacacggtggaggacctcgtggccctgaacccctacaaccccgacatcctcaacgacctcgagaagttcgtcaatgagcaggtctcatctcagacatataacttggatgcaaatctcagccttcttcgcttgtaccagtttgagccagaaaggatgagcatacagattgtggcccacatactgattaagggtctcatggccatgccagcccctgacttcagttggggctattctttatccctgaacatgtgcaattnaagagcaatttcagggattgataggtctttcctcctacctaaagactgctgggtccgtccattttgggatgaagcaacaagaacccccctatccgaagcatggc

SEQ ID NO: 36403 - protein, 129 aa, Zea mays
  misc_feature: Ceres CLONE 1420019-F
  misc_feature (95)..(95): Xaa is any aa, unknown, or other
MATEQAAENYTVEDLVALNPYNPDILNDLEKFVNEQVSSQTYNLDANLSLLRLYQFEPERMSIQIVAHILIKGLMAMPAPDFSWGYSLSLNMCNXRAISGIDRSFLLPKDCWVRPFWDEATRTPLSEAW

SEQ ID NO: 36404 - DNA, 647 bp, Zea mays
  misc_feature: Ceres CLONE 1420025-F
  misc_feature: Encodes the peptide sequence at SEQ ID NO. 36405
  misc_feature (494)..(494): n is a, c, t, g, unknown, or other
atagctggagctccccgcggtggcggccgctctagaactagtggatcccccgggctgcaggaattcgcacgagaccattacctagaacatcctaatcaaaagtgttcttgttcgtctccgcctcaggcaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcggatcgagatcgtcgctggggatgacgccctcgggggcaaaggcgccaccggcgaggggtgctcatctcttggcgactgggcgtgccancgcaagcgacgacgggaggagctccgacgcgacaagaatctagaaaatactggcagatccagcaaactgccaagttgagctgaagatgggatgcctaccaaggagggcatgaacctggagctatgaaaaaagatctccgcctgaaattgaggg

SEQ ID NO: 36405 - protein, 83 aa, Zea mays
  misc_feature: Ceres CLONE 1420025-F
  misc_feature (58)..(58): Xaa is any aa, unknown, or other
MDPDFSPASGGPSFEFAFNSVNFSDRVLRIEIVAGDDALGGKGATGEGCSSLGDWACXRKRRREELRRDKNLENTGRSSKLPS

SEQ ID NO: 36406 - DNA, 709 bp, Zea mays
  misc_feature: Ceres CLONE 1420036-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (213)..(213): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (235)..(235): n is a, c, t, g, unknown, or other
  misc_feature (248)..(248): n is a, c, t, g, unknown, or other
  misc_feature (250)..(250): n is a, c, t, g, unknown, or other
  misc_feature (251)..(251): n is a, c, t, g, unknown, or other
  misc_feature (255)..(255): n is a, c, t, g, unknown, or other
  misc_feature (262)..(262): n is a, c, t, g, unknown, or other
  misc_feature (269)..(269): n is a, c, t, g, unknown, or other
  misc_feature (298)..(298): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnccccnaaaannnnncccaagactgggngactccaccgccngnntggncggccgnctctagnaactagtggaatccccccgggctgcaggnaattcgcacgagaccattacctagaacatcctaatcgaaaaacacattccgcgcacaccccggcagccgcaaacgccttcgccgtcgcgtcccgcttcctcgccccgcccgaagcgacccctaaggacctggagaagagaggtccggcattggctggcgcagtgggtcgaacgaagccttggttattggacgccccgtccccaaaaacccccctcctgggttccaaagaaacaaaaggggcttttttgggggggaaccaaacccggggacaaatgtttttttttgggccctttgggggctcaaaaattaccccccgggcccctttgttggggggggaaaaaaaaaattgtgttttttttttgaaaaaaaaatttcccccccccaagggggggggttttttccggggggggg

SEQ ID NO: 36407 - DNA, 665 bp, Zea mays
  misc_feature: Ceres CLONE 1420038-F
  misc_feature: Encodes the peptide sequence at SEQ ID NO. 36408
  misc_feature (358)..(358): n is a, c, t, g, unknown, or other
aaagctggagctccccgcggtggcggccgctctagaactagtggatcccccgggctgcaggaattcgcacgagaccattacctagaacatcctaatcgaaaacattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtngtcgatgatttcgagaggttcgcacccacggcggccacagtgagctcgtcgctgctgcttgggatcactgggctcccagacactaaagtcaggaatgcgatagatactgcactgggcaatggtgagtgcaaccccctgaaaaagcttaggacaggatttcttgtacctccccaaggtccttgaaaaggtttgccctaaattggttcataaaggcttgggaagatttcaccgaaaaaaaggcctgttaacttttaaacccccgggaaaatccccgggggaaaaaaatttttaaattttaaccccaaga

SEQ ID NO: 36408 - protein, 136 aa, Zea mays
  misc_feature: Ceres CLONE 1420038-F
MALSIYTPTSSSLVPPSIQEVRLTSRPPKPATFSLRRPHLAARAAAGNAPTSPVREVVTELDAVAGFSEIVPDTVVVDDFERFAPTAATVSSSLLLGITGLPDTKVRNAIDTALGNGECNPLKKLRTGFLVPPQGP

SEQ ID NO: 36409 - DNA, 640 bp, Zea mays
  misc_feature: Ceres CLONE 1420040-F
  misc_feature: Encodes the peptide sequence at SEQ ID NO. 36410
aagctggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgattcttccgcgtcgatcgtcggtctgctggatcgtattcggatgggtgatttgagcgtctgggttgtcagctgcgcgccagagggcagcctgttggcggcggcgatggagctgcatcatcgcgcgcagaaggaggctatggcgccgcagcatgctcaagctccgcccctcttcttggacttctcgcatggaggtaagcagatcaaacaaagcgcactccttggctccgctgcagatttcgtcttcttgggaagcagcaccgcacccttctgctccgatttcggatcgtgaacatgtcgccagggatcta

SEQ ID NO: 36410 - protein, 82 aa, Zea mays
  misc_feature: Ceres CLONE 1420040-F
MGDLSVWVVSCAPEGSLLAAAMELHHRAQKEAMAPQHAQAPPLFLDFSHGGKQIKQSALLGSAADFVFLGSSTAPFCSDFGS

SEQ ID NO: 36411 - DNA, 647 bp, Zea mays
  misc_feature: Ceres CLONE 1420046-F
  misc_feature: Encodes the peptide sequence at SEQ ID NO. 36412
aagctggagctccccgcggtggcggccgctctagaactagtggatcccccgggctgcaggaattcgcacgagaccattacctagaacatcctaatcgaaaagaggaaaaatctcgcattcgcaaaccaagcaaatggaggcatgagctccgccgcctccccgtctctcgccgatctcccccaaaccctagcctcgacctgaccgccagcgggcccgcaggccggagaaggagtcggagtcgcccccacccacccaccctctgccgcgggcggtgagcgggcggcggacgagatgccgtcgcacggagatctggaccggcagatcgcgcagctgcgacgactgcaagtacctgcccgaggcggaggtcaaggtgctctgcgagcaggccaaggccatcctcatggaggaatggaacgtgcagcccgtgcgctgccccgacaccgtctgcggcgacatccacggccagtactatgacctcatcgagctcttccgcatcgagtgcgactctcccgacaccaactacctctacatgggcgactacgacgatcgtggctattattcggttgacacggtttctctgctggtcgccttgatagtccgttacagagatagaattaccatacttcgaggaaatcatgagagcagac

SEQ ID NO: 36412 - protein, 82 aa, Zea mays
  misc_feature: Ceres CLONE 1420046-F
  misc_feature: SWISSPROT Homolog: EC 3.1.3.16 Phosphoprotein phosphatase
MEEWNVQPVRCPDTVCGDIHGQYYDLIELFRIECDSPDTNYLYMGDYDDRGYYSVDTVSLLVALIVRYRDRITILRGNHESR

SEQ ID NO: 36413 - DNA, 514 bp, Zea mays
  misc_feature: Ceres CLONE 1420056-F
  misc_feature: Encodes the peptide sequence at SEQ ID NO. 36414
aaagctggagctccccgcggtggcggccgctctagaactagtggatcccccgggctgcaggaattcgcacgagaccattacctagaacatcctaatcgaaaattccagtgccgagcaacaagctcgtttccgcatacgcccaaggcgaggcatttcatcgaacataacgaccccccgttccaaaccatgccgctcacgaagctccacccctccctcgccgccgcctccacgctgaccccgaagcatagcctgaacgcaaaccgcgttgtggccctgaccccgtcggcgtcccaccgcagcggcggtctcccgggtctccgcccgctcggtggcggcgggcccagccaaacacgggcgtcacctgaaagcgggggcttgcggcgggacttaaccgcgtggaattgccttcgaaagcgctccccgttcttccaaaggttcaggggcaaaacgggggggggcaaaaaccggggggccgggcaataaaaccccccagaaccccaggggtccgttaaat

SEQ ID NO: 36414 - protein, 98 aa, Zea mays
  misc_feature: Ceres CLONE 1420056-F
MPLTKLHPSLAAASTLTPKHSLNANRVVALTPSASHRSGGLPGLRPLGGGGPSQTRASPESGGLRRDLTAWNCLRKRSPFFQRFRGKTGGGKNRGAGQ

SEQ ID NO: 36415 - DNA, 725 bp, Zea mays
  misc_feature: Ceres CLONE 1420066-F
  misc_feature: Translation starting site: 168
  misc_feature (444)..(444): n is a, c, t, g, unknown, or other
  misc_feature (489)..(489): n is a, c, t, g, unknown, or other
  misc_feature (611)..(611): n is a, c, t, g, unknown, or other
aagctggagctccccgcggtggcggccgctctagaactagtggatcccccgggctgcaggaattcgcacgagaccattacctagaacatcctaatcgaaaagcacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaactgctgacgttctgttatggaaagacagaaaacttctgctgttgtaataggcggcgcaactgtcatctnggttctgttcgaagtgcttgattaccacctccctgacctgatatnccatgtactgattggtgtgcttgccaccttattcctggtggtcaaaagcaccacgttcatcaagagagtccaccggatattccagtagtgcaggtatctgaggaccttgttgtgaatgtttncacggcattcggaatgacatccacagagcgcttcccttgtccgtgagatcgccatggggcatgatctgaagaagtttttgggtgtgatcggtgggtctggggttcccctccgga

SEQ ID NO: 36416 - DNA, 710 bp, Zea mays
  misc_feature: Ceres CLONE 1420069-F
  misc_feature: Encodes the peptide sequence at SEQ ID NO. 36417
  misc_feature (392)..(392): n is a, c, t, g, unknown, or other
ggagctccccgcggtggcggccgctctagaactagtggatcccccgggctgcaggaattcgcacgagacaattacctagaacatcctaatcgaaaactcttttccgccctccacccctcgcgagctctccacccctccacacgaccctcctcggcggcggcggcggcgatgcagatggcggcgaccaccaccgagtcccaggcggccgtgccgcctcgacaccctcacgcccacccccacgcgcccccgcaggatgctcacccgcaccaccacatgccgcagccacggtgggtcggcatcccgtacccgccgccgccgcccatggtggccgcgccaccaccgccgccacaggttgccaagcacttcactgctggggcggcggcggcgccccnagctggtgctgagcggcgcacgccgaccccgccctcgtctggatccagcgggaacggacgcgaagaaaataaagccagttggggccgtgacctccagtcctggatggaggaaaactacctgcagaactgcttcaggcccagaggcgaggtgggtaccatacaagttatcctcgatagggcaacgggacagtcagatgggtatggcattgggggagtcctcttctcactgatacggcgagaaaagctcctcacaagtgtactgggtcatgtgatgcccaacactggacgcgggctttaaatcggaaccggggattcccg

SEQ ID NO: 36417 - protein, 173 aa, Zea mays
  misc_feature: Ceres CLONE 1420069-F
  misc_feature (75)..(75): Xaa is any aa, unknown, or other
MQMAATTTESQAAVPPRHPHAHPHAPPQDAHPHHHMPQPRWVGIPYPPPPPMVAAPPPPPQVAKHFTAGAAAAPXAGAERRTPTPPSSGSSGNGREENKASWGRDLQSWMEENYLQNCFRPRGEVGTIQVILDRATGQSDGYGIGGVLFSLIRREKLLTSVLGHVMPNTGRGL

SEQ ID NO: 36418 - DNA, 628 bp, Zea mays
  misc_feature: Ceres CLONE 1420070-F
  misc_feature: Encodes the peptide sequence at SEQ ID NO. 36419
  misc_feature (420)..(420): n is a, c, t, g, unknown, or other
  misc_feature (477)..(477): n is a, c, t, g, unknown, or other
  misc_feature (535)..(535): n is a, c, t, g, unknown, or other
aaagctggagctccccgcggtggcggccgctctagaactagtggatcccccgggctgcaggaattcgcacgagaccattacctagaacatcctaatcgaaaaaattagccagcccacctctgctctgcgggcgcttcagatggaagcactagccattggatccgcgcctcgccgtccgggcgcaaggtactcccaactccgccgccccggaaccctcgccgtcaccaccacagccacagttgcatgccgccccctcacggcgccctccatggacgccgccgttggccgcccgagccgcgcgcctatccgctgcaccagcgcggagacggactcggtggatgaggtcgcgacgagctcgcacgccgcggaggccaacgcggggggcacccacgagcaagagggcaacgggagccccgtggnccgcgctgccgcgtactcccccgtggtcgcccgcgtcgacgggataaggatccggcngcggcccgtgacggggcccgcggtgcactacgtggggcccggttcagtttccgcctcnagaacgaaggggaaccgccccgggaacatcctcagaaaatccatcgggacaaggacctctaagttttcccaaattaaggaaaaggagcccttg

SEQ ID NO: 36419 - protein, 120 aa, Zea mays
  misc_feature: Ceres CLONE 1420070-F
  misc_feature (51)..(51): Xaa is any aa, unknown, or other
  misc_feature (70)..(70): Xaa is any aa, unknown, or other
MDAAVGRPSRAPIRCTSAETDSVDEVATSSHAAEANAGGTHEQEGNGSPVXRAAAYSPVVARVDGIRIRXRPVTGPAVHYVGPGSVSASRTKGNRPGNILRKSIGTRTSKFSQIKEKEPL

SEQ ID NO: 36420 - DNA, 711 bp, Zea mays
  misc_feature: Ceres CLONE 1420072-F
  misc_feature: Encodes the peptide sequence at SEQ ID NO. 36421
  misc_feature (404)..(404): n is a, c, t, g, unknown, or other
ggagctccccgcggtggcggccgctctagaactagtggatcccccgggctgcaggaattcgcacgagaccattacctagaacatcctaatcgaaaagacaccccctccgctctccttatcccttccattcgcccaaacccccgccgccgtgacccctgccagcccgcggccttcccctcgttctaggcttcaactgccggcctcgtgtcttctgggcaagtgaagagagagatggcgtcgccaataccgcgcgagtgggtcgggctgcagcagtttcctccggccacccagaccgagctgcacgagctcctcggcaagctcaaggaggaggatgtgagcacattgacaattctggtgatggggaaaggcggagtggggaagtcatctactgttaactccatcgntcgggagaagatcgccactgtcagcgctttccagtctgagggtctgagaccgatgatgtggtcgcccacaagggcagggtccacctggacattaccaaacccctggggctttttgaggggggatactttaatgagccggggtgttaaattattaaaagattccctcggggcaaaacaattgaggtcccccctgaaggggaaacctttgggacccccccaaaaaggaaccccttttgtggaccgggttaaaaaaccccccccccaattctttttgaaaaaaaatttttgggaaaaaaatatttgtttt

SEQ ID NO: 36421 - protein, 160 aa, Zea mays
  misc_feature: Ceres CLONE 1420072-F
  misc_feature (58)..(58): Xaa is any aa, unknown, or other
MASPIPREWVGLQQFPPATQTELHELLGKLKEEDVSTLTILVMGKGGVGKSSTVNSIXREKIATVSAFQSEGLRPMMWSPTRAGSTWTLPNPWGFLRGDTLMSRGVKLLKDSLGAKQLRSPLKGKPLGPPQKGTPFVDRVKKPPPQFFLKKNFWEKNICF

SEQ ID NO: 36422 - DNA, 731 bp, Zea mays
  misc_feature: Ceres CLONE 1420081-F
  misc_feature: Encodes the peptide sequence at SEQ ID NO. 36423
aaagctggagctccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgctttttagaatgtatcttaatttattgtagaggttttatcttcactcttttgacttgagcagtgtttggtttct

SEQ ID NO: 36423 - protein, 118 aa, Zea mays; identical to SEQ ID NO: 12523
  misc_feature: Ceres CLONE 1420081-F
  misc_feature (13)..(116): Pfam Name: MAP1_LC3 Pfam Description: Microtubule associated protein 1A/1B, light chain 3

SEQ ID NO: 36424 - DNA, 719 bp, Zea mays
  misc_feature: Ceres CLONE 1420088-F
  misc_feature: Encodes the peptide sequence at SEQ ID NO. 36425
  misc_feature (417)..(417): n is a, c, t, g, unknown, or other
aaagctggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccatagtgcttaaaaaaaggtatgggtcttaccanaaggacaaaaggactggggcgtccaaaaatttggatatacagggacaaagttactaatgaaccaaagggtgatgcaacagtcacctatgaggatccacatgctgcttcagctgctgtggaatggttcgataacaaggatttccatgggagcactattcaggttcacatagctgagtcaaaaagcaaagatgcattcgataaccccacaagtttgaacatcattggtggtgttggtgaacaagatgaactggataatggagcaggcagaggcagagggcgtggtgatggtccaggcaaggctt

SEQ ID NO: 36425 - protein, 105 aa, Zea mays
  misc_feature: Ceres CLONE 1420088-F
  misc_feature (5)..(5): Xaa is any aa, unknown, or other
MGLTXRTKGLGRPKIWIYRDKVTNEPKGDATVTYEDPHAASAAVEWFDNKDFHGSTIQVHIAESKSKDAFDNPTSLNIIGGVGEQDELDNGAGRGRGRGDGPGKA

SEQ ID NO: 36426 - DNA, 645 bp, Zea mays
  misc_feature: Ceres CLONE 1420090-F
  misc_feature: Encodes the peptide sequence at SEQ ID NO. 36427
  misc_feature (424)..(424): n is a, c, t, g, unknown, or other
  misc_feature (425)..(425): n is a, c, t, g, unknown, or other
  misc_feature (479)..(479): n is a, c, t, g, unknown, or other
  misc_feature (488)..(488): n is a, c, t, g, unknown, or other
aaagctggagctccccgcggtggcggccgctctagaactagtggatcccccgggctgcaggaattcgcacgagaccattacctagaacatcctaatcgaaaagacccttcacattcccagttccctctgcgccccgtaaaccctagccgcgattcatggcccgcaagcgccgcgcgccttcgcctcctccgcctccgcaggaggagtcgtcctctgaggaatctggctccgaagagttggaggagcctcctcgcctccccgagctccgtagtcccccgcaggccgcggccaacaacgccgactcgtcggaggcggacacggactccgacaccgacgctcaagctttccagatgcgccaggtgccccgctccctcactaagcatacgcatccagttccccagccagaatccgatcccgaagaggnnagaggcgagtcatcggagtcggagcatgagaaccctgtgcctgtggttcaaaanaaagctgcngccgccgccgtgtttgtccaagcagagcaggaaaagaagagacccccctcggatcctgctcctaccgggaaggcaaaaaagatgaaggttgtggctacccctcttgccaaggccaaaaaaggccaggccgaaccttaaaaaacccgggcccctgagg

SEQ ID NO: 36427 - protein, 156 aa, Zea mays
  misc_feature: Ceres CLONE 1420090-F
  misc_feature (90)..(90): Xaa is any aa, unknown, or other
  misc_feature (108)..(108): Xaa is any aa, unknown, or other
MARKRRAPSPPPPPQEESSSEESGSEELEEPPRLPELRSPPQAAANNADSSEADTDSDTDAQAFQMRQVPRSLTKHTHPVPQPESDPEEXRGESSESEHENPVPVVQXKAAAAAVFVQAEQEKKRPPSDPAPTGKAKKMKVVATPLAKAKKGQAEP

SEQ ID NO: 36428 - DNA, 626 bp, Zea mays
  misc_feature: Ceres CLONE 1420092-F
  misc_feature: Encodes the peptide sequence at SEQ ID NO. 36429
aaagctggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcgg

SEQ ID NO: 36429 - protein, 123 aa, Zea mays
  misc_feature: Ceres CLONE 1420092-F
  misc_feature: SWISSPROT Homolog: EC 1.14.13.93 (+)-abscisic acid 8'-hydroxylase
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPS

SEQ ID NO: 36430 - DNA, 762 bp, Zea mays
  misc_feature: Ceres CLONE 1420094-F
  misc_feature: Translation starting site: 167
  misc_feature (325)..(325): n is a, c, t, g, unknown, or other
  misc_feature (372)..(372): n is a, c, t, g, unknown, or other
  misc_feature (380)..(380): n is a, c, t, g, unknown, or other
  misc_feature (407)..(407): n is a, c, t, g, unknown, or other
  misc_feature (414)..(414): n is a, c, t, g, unknown, or other
  misc_feature (482)..(482): n is a, c, t, g, unknown, or other
aaagctggagctccccgcggtggcggccgctctagaactagtggatcccccgggctgcaggaattcgcacgagaccattacctagaacatcctaatcgaaaagccaaggaaacagtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgccgcccgctgctgggcgggtggaacccgatccctgacgtgagcgactcgcacatccaggagctaggncgggtgggcgctggggcaggcaaaacaccagaagctggccgccaacnggctgcgntccggcggcgtggtgcgcggcaagcancaggtcntgtcccggaatgactaacggcttctacgttgacggcgcccaaccccggcgggccgaccgtggccctanttccccttttggtacaaacaagtcttggaaccccaccccgcaagttccccttctttaaaccggggggcccgggccccttgaaaaccatcccccaccgggggggcccaaaaccaatttctccccccaataagggggcagagaaaactaaaaaggggtcccaaaaaaaaaaaagggtccccccccggccccgtgggccccttggggaatacccaaaattgtgggagggggaagaaaaaacccgttgttttcccttctggggggaaaaaataaccccctttaa

SEQ ID NO: 36431 - DNA, 638 bp, Zea mays
  misc_feature: Ceres CLONE 1420095-F
  misc_feature: Encodes the peptide sequence at SEQ ID NO. 36432
  misc_feature (207)..(207): n is a, c, t, g, unknown, or other
  misc_feature (609)..(609): n is a, c, t, g, unknown, or other
tataagctggagctccccgcggtggcggccgctctagaactagtggatcccccgggctgcaggaattcgcacgagaccattacctagaacatcctaatcgaaaaagatcttgatccgttcctgttcctgttcctgctgctagctgctggttgctggggccgtgtacgtacgcgttgatgaaggtgaccgtggaagggagcggcgccngcccggccgcggtcaagaggaggcggagtggcgcgcctggcaggcgccagagcggcggcgtgagcgtgcggcggcgcgtgcaggtggacgcggcgaccgcgccagagccggcgccgctccagcgtctgcttgccgcgtgccgccgcgcgttcggaggccccgggaccgtgccggcgcaccacgacgtcgtcctcatcagagacatcctcgacaagatgggaccagaggatgtgcacctgagaggcgtcaccaaggccggcgccgcttccggcgggcctcgaacgcaccctgttcctatcatcacacgaaccaccatttataaatgcaagaacctcctcgggcgtggtgttccctgctgcccccaggcgcgaccatccctctgcccaacacccggggatgacngggttcaacaagcttcttcccggctcgct

SEQ ID NO: 36432 - protein, 154 aa, Zea mays
  misc_feature: Ceres CLONE 1420095-F
  misc_feature (11)..(11): Xaa is any aa, unknown, or other
  misc_feature (145)..(145): Xaa is any aa, unknown, or other
MKVTVEGSGAXPAAVKRRRSGAPGRRQSGGVSVRRRVQVDAATAPEPAPLQRLLAACRRAFGGPGTVPAHHDVVLIRDILDKMGPEDVHLRGVTKAGAASGGPRTHPVPIITRTTIYKCKNLLGRGVPCCPQARPSLCPTPGDDXVQQASSRLA

SEQ ID NO: 36433 - DNA, 724 bp, Zea mays
  misc_feature: Ceres CLONE 1420106-F
  misc_feature: Translation starting site: 207
  misc_feature (578)..(578): n is a, c, t, g, unknown, or other
  misc_feature (580)..(580): n is a, c, t, g, unknown, or other
  misc_feature (581)..(581): n is a, c, t, g, unknown, or other
  misc_feature (583)..(583): n is a, c, t, g, unknown, or other
  misc_feature (722)..(722): n is a, c, t, g, unknown, or other
caaagctggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgccgtgacncnngnccgggcaggggaggaagaggctgctggtggtggtcggcggctgggacccggagacgtgggcgccgacggacgcggtgctcgtctacgacttcctgtcgggcgcgtggcggcgcggcgcgcccatgcccggcccgcgcangt

SEQ ID NO: 36434 - DNA, 736 bp, Zea mays
  misc_feature: Ceres CLONE 1420108-F
  misc_feature: Encodes the peptide sequence at SEQ ID NO. 36435
  misc_feature (472)..(472): n is a, c, t, g, unknown, or other
ctggagctccccgcggtggcggccgctctataactagtggatcccccgggctgcaggaattcgcacgagaccattacctagaacatcctaatcgaaaagacacccttgctcgcccgcatctctctaaccgccggcgccggcgccggcgccggccatcgttcacatggctgcgatgccaccggccttcacgggcaacctgaagaaagcacttgcaggtctgagaagaatcaatttagatgggcttcgatggcgcgtatttgatgctaagggtcaggtgctgggacgattggcttcccaaatagccgttgtgcttcaaggcaaggataaaccgacctatgcgccacatgtggaaaatggagacatgtgcattgtacttaatgcacaggatatcagtgttacaggaaggaaaatgacagataagatttactactggcatacagggtatgttggccatttgaaggaaaggaggctncaggaccagatggagaaagacccaactgaagtgattcgcaaagctgtgctgcgcatgcttccccgcaacaaactgcgtgatgatagggatcgcaagctgcggatattttctggaattgagcatccatcccatgaccgccctcttgaaccttttgtaatgccccacggcaagtacgggagatgcgaccccgtgcaaggcgtgcaatgttaaggcccaagaaaaagagcatccaaccgggccaaggaggaagaagatcctaaaaat

SEQ ID NO: 36435 - protein, 172 aa, Zea mays
  misc_feature: Ceres CLONE 1420108-F
  misc_feature (29)..(158): Pfam Name: Ribosomal_L13 Pfam Description: Ribosomal protein L13
MAAMPPAFTGNLKKALAGLRRINLDGLRWRVFDAKGQVLGRLASQIAVVLQGKDKPTYAPHVENGDMCIVLNAQDISVTGRKMTDKIYYWHTGYVGHLKERRLQDQMEKDPTEVIRKAVLRMLPRNKLRDDRDRKLRIFSGIEHPSHDRPLEPFVMPHGKYGRCDPVQGVQC

SEQ ID NO: 36436 - DNA, 713 bp, Zea mays
  misc_feature: Ceres CLONE 1420114-F
  misc_feature: Encodes the peptide sequence at SEQ ID NO. 36437
  misc_feature (510)..(510): n is a, c, t, g, unknown, or other
  misc_feature (511)..(511): n is a, c, t, g, unknown, or other
  misc_feature (536)..(536): n is a, c, t, g, unknown, or other
  misc_feature (544)..(544): n is a, c, t, g, unknown, or other
ggagctccccgcggtggcggccgctctataactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcgggcccttcgggcgttctnnaatttttttggggcccccttgtaantaagaccngcataatcttacttttgcctcttgtctcttccccgaccttatgtgtgtctcgtcgccctcccctgatccagcgatctttttttttctctcctgtttatggcttctacagactgttaatacccctgcatggcacaacagccgagtttgcccgtggtccgtccttttttgc

SEQ ID NO: 36437 - protein, 114 aa, Zea mays
  misc_feature: Ceres CLONE 1420114-F
  misc_feature (36)..(111): Pfam Name: Oleosin Pfam Description: Oleosin
  misc_feature (107)..(107): Xaa is any aa, unknown, or other
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGPFGRSXIFLGPPC

SEQ ID NO: 36438 - DNA, 682 bp, Zea mays
  misc_feature: Ceres CLONE 1420115-F
  misc_feature: Encodes the peptide sequence at SEQ ID NO. 36439
aaagctggagctccccgcggtggcggccgctctagaactagtggatcccccgggctgcaggaattcgcacgagaccattacctagaacatcctaatctaaaaaaagccttggacggatccaatattttagctagctagcaagcaaagcaagccttgaacttttgagcggcggctagcgcaatgggaggcgtggcgtcggagctggtgggagccagcagggagaggcagagcaggaagaggaagcagttccacacggtggagctcaaggtcaggatggactgcgacggctgcgagctcaaggtcaggaacacccttgcccgcatgagaggggtggagtcggtggagatcaaccggaagcagcagaaggtgacggtgaaggggttcgtggaggcgcagcgggtgctgaggcgcgcccagtccacggggaagcgcgtcgagctgtggccctacgtgccctacaccaacctctacgtcgcgcccgcggtgtacgacaagagggcgccgccgggccacgtccgcagggtcgacgcactcatcgcggccgccgccggccagggagaagcaccttcgccaccgctcttcagcgacgataacccccaacgcctgctcccttatgggattcctccagctaaaaaccgccccgccttgctcccccggctttattatgcgaaggccaagctgg

SEQ ID NO: 36439 - protein, 167 aa, Zea mays
  misc_feature: Ceres CLONE 1420115-F
  misc_feature (27)..(87): Pfam Name: HMA Pfam Description: Heavy-metal-associated domain
MGGVASELVGASRERQSRKRKQFHTVELKVRMDCDGCELKVRNTLARMRGVESVEINRKQQKVTVKGFVEAQRVLRRAQSTGKRVELWPYVPYTNLYVAPAVYDKRAPPGHVRRVDALIAAAAGQGEAPSPPLFSDDNPQRLLPYGIPPAKNRPALLPRLYYAKAKL

SEQ ID NO: 36440 - DNA, 639 bp, Zea mays
  misc_feature: Ceres CLONE 1420117-F
  misc_feature: Encodes the peptide sequence at SEQ ID NO. 36441
aaagctggagctccccgcggtggcggccgctctagaactagtggatcccccgggctgcaggaattcgcacgagaccattacctagaacatcctaatcgaaaacttatcgttatggcttccgtcgctttgccggcgttcacctgccggagctcagcagatccgacgaaggaacttcgcgtctgcacgaaccgcacctgccgaaaacaaggctcattccaaatcctcgagacgctaacgtccctcgcacctccccaactccaagtcaatccctgcggctgcctcggccgatgcggctcgggtccgaacctcgtcgctctccctcaaggtctcttccttcgtcactgcgccacgccttctcgagctgctgaaatcttgttcagcctatgcggcgacggcagggaagcttcctcttcctccgccgtcgcagaggctctcgccgctttggcgctaaccaacaatgctctctctcagatcgaagctgagaacttcgaagaagcagagtcgcttctcacacaggctttagagatgaaaccatacggtggactgcatagaatcttcaaacacagagcagtggcgaaactaggaatgggttgatactctggggctcttgaagatataagccaagctctagcattaggt

SEQ ID NO: 36441 - protein, 160 aa, Zea mays; identical to SEQ ID NO: 21664
  misc_feature: Ceres CLONE 1420117-F

SEQ ID NO: 36442 - DNA, 641 bp, Zea mays
  misc_feature: Ceres CLONE 1420120-F
  misc_feature: Translation starting site: 296
  misc_feature (593)..(593): n is a, c, t, g, unknown, or other
  misc_feature (641)..(641): n is a, c, t, g, unknown, or other
atagctggagctccccgcggtggcggccgctctagaactagtggatcccccgggctgcaggaattcgcacgagaccattacctagaacatcctaatagaaaactccccagcccccgccccggtcgcggagccgtcgttctcgtctttcggtactcgcgcgcgccagctcacttctctacttcccttccccagatctacctccattcttccctcaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgagtgagttctgatttaccgagtcgtcattcctgttgctggttgaagttgttggatttgatgtggtgccccgcgtgtgttgcagcaattggattcaacgttgagacggtgcagtacaaccacatcaagttccaagtatgggatcttggtggtcaaacnagcatcaggtaccgggctcttatcatgatagtaaattcctgactgtcn

SEQ ID NO: 36443 - DNA, 645 bp, Zea mays
  misc_feature: Ceres CLONE 1420121-F
  misc_feature: Encodes the peptide sequence at SEQ ID NO. 36444
  misc_feature (557)..(557): n is a, c, t, g, unknown, or other
  misc_feature (616)..(616): n is a, c, t, g, unknown, or other
aagctggagctccccgcggtggcggccgctctagaactagtggatcccccgggctgcacgaattcacacgagaccattacctagaacatcctaatcgaaaaaaaatcttccaagtcaccaacgcaaattgcaccaagaaatccatcgagaggccgtccacaggggaattaatggcgtcgtcgtctagcaacagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcaggtcgcgcctcccgtggacggagctgaatacgagatgctgccgggagctggcggacatcccggcgtactgccagtgcacggcgctgagcatcctcatggacggctcgatcccgccgggtccggacgcgcatctggagggccgcctagaggacatgccaggctgcccgcggagagtgcataggggattcttcgccaccctcgtcacgaangccgagtgcaacctagccacatcagcggctgtctccgatgcccctggattctggcggcngaacgatgcccttcagtcactgcaaagac

SEQ ID NO: 36444 - protein, 158 aa, Zea mays
  misc_feature: Ceres CLONE 1420121-F
  misc_feature (34)..(139): Pfam Name: Tryp_alpha_amyl Pfam Description: Protease inhibitor/seed storage/LTP family
  misc_feature (129)..(129): Xaa is any aa, unknown, or other
  misc_feature (149)..(149): Xaa is any aa, unknown, or other
MASSSSNSHRRLILAAAVLLSVLAAASASAGTSCVPGWAIPHNPLPSCRWYVTSRTCGIRSRLPWTELNTRCCRELADIPAYCQCTALSILMDGSIPPGPDAHLEGRLEDMPGCPRRVHRGFFATLVTXAECNLATSAAVSDAPGFWRXNDALQSLQR

SEQ ID NO: 36445 - DNA, 648 bp, Zea mays
  misc_feature: Ceres CLONE 1420122-F
  misc_feature: Encodes the peptide sequence at SEQ ID NO. 36446
aaagctggagctccccgcggtggcggccgctctagaactagtggatcccccgggctgcaggaattcgcacgagaccattacctagaacatcctaatcgaaaaatctcgtcgctcggctcccgaccgcatcgcgatcagtcatctcctgcgtctcgttctcgccggagatcagacgcgccaccgccgggcgatggatgcctcctaccgccgcgccggtgccggaagcggttctgctccccgctccgtcgaggacatctacaaggactaccgcgcccgccgctccgccgtcctccgcgccctcacccacgacgtcgaggagttctacgcgctgtgcgatccagagaaggagaacctgtgcctatacgggtacgcaaacgaagcgtgggaggtggcgctgccggcggaggaggtgcccacggagctgccggagcctgcgctcgggatcaacttcgcgcgcgacgggatgaaccgtcgcgactggctcgcgctcgtcgccgtccactccgactcgtggctcatatccgtcgcattctactacgccgcgcggctcaaccgaagggatcgtcgtctccggtggtgtggagccatcctaaggaagggacagatccggtactgacaaccgggggtagaaataaactggccgcaaag

SEQ ID NO: 36446 - protein, 141 aa, Zea mays
  misc_feature: Ceres CLONE 1420122-F
MDASYRRAGAGSGSAPRSVEDIYKDYRARRSAVLRALTHDVEEFYALCDPEKENLCLYGYANEAWEVALPAEEVPTELPEPALGINFARDGMNRRDWLALVAVHSDSWLISVAFYYAARLNRRDRRLRWCGAILRKGQIRY

SEQ ID NO: 36447 - DNA, 692 bp, Zea mays
  misc_feature: Ceres CLONE 1420140-F
  misc_feature: Translation starting site: 237
  misc_feature: SWISSPROT Homolog: EC 4.1.1.33 Diphosphomevalonate decarboxylase
tccccgcggtggcggccgctctagaactagtggatcccccgggctgcaggaattcgcacgagaccattacctagaacatcctaatcgaaaaaatccatttacctgtccaccaaaccagtctgtagtgttttttccctccctaatgaacagaccacggaggtgacgaagcagcggtagagacaaattagcgagcagagaaggggtactggcgatgacacaccttgccattgagccacatgcggtcggaagggaatgaggggctgacggcgacagtggtggtggcgcagagatggtcggggtcgagcgttacgctgatgctgtcgttgatggggaggatgagcgcctcgtcccgcttcccccagtacttgatcaccgcaatgttggtcggcgtccgccccgttgccatgagcacccactgcccctccgccgccgccattggatctctcgcttcgcgctgctctatgcccgataattccttgcaaagggaagttagtaggcataatcccctactactcttatagcacggtgtgtagggggggcacaccgggcggccatcgtttctgccagccctccccaatgctccccctggcagggatccgggtcacacctttttggtcgccgccaatcattcggatttaccctgccccctcaaagattccttcccccttccgggtcccccgggccacaggata

SEQ ID NO: 36448 - DNA, 714 bp, Zea mays
  misc_feature: Ceres CLONE 1420144-F
  misc_feature: Translation starting site: 196
  misc_feature (430)..(430): n is a, c, t, g, unknown, or other
  misc_feature (438)..(438): n is a, c, t, g, unknown, or other
  misc_feature (626)..(626): n is a, c, t, g, unknown, or other
ctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgaccgcctccgtggtggggctggccgtgnccacgccngtgttcctgatcttcagcccgtgctggtccccgccgcgctgctcatcgggacggccgtcatggggttcctcacgtcgggcgcgctggggctcggggggctgtcctcgcttacgtgcctccgcaacacggcgcggcaggcgtttcagcgcaccccggactacgtggaagaaggccaccgcaggatggcngaaggcgcggcccacgcggggccaaaagacgcccaggcaggccaggcattcagggcaaggcccaagacgccggccccggggaaggtca

SEQ ID NO: 36449 - DNA, 457 bp, Zea mays
  misc_feature: Ceres CLONE 1420148-F
  misc_feature (225)..(225): n is a, c, t, g, unknown, or other
atagctggagctccccgcggtggcggccgctctagaactagtggatcccccgggctgcaggaattcgcacgagaccattacctagaacatcctaatcaaaaatatctcctcaaggcacgttcaccacagtcctctctttccccggcaccaccaccacccaggctaaccggactggaccgagtgttgaacaacactgagggcgaaggcagataagagcgaacggcnagggcatggtgaagccgtgaaaattttgcaccctgggtgctgggaccccgggcggtctcttggggcgcgcccgtggggcccgaccccgtcccgcccgcaaaaagatccccgcccgcaagcttccttcgcccccccccttgggggaaaaaagtaccctttttttcccttcccacaaccccgggggccccccaaagggggggggggggaaaaaaaattttcccccccgaaaaat

SEQ ID NO: 36450 - DNA, 862 bp, Zea mays
  misc_feature: Ceres CLONE 1420151-F
  misc_feature: Encodes the peptide sequence at SEQ ID NO. 36451
tgtggttttttcttggggtcggggcggttcgtttgttttttttttttatgctggggctcaccgcggtggcggccgctctagattagtggatcccccgggctgcaggaattcgcccgagaccattacctacaacatcctaatcgaaaaatgtttgcgaccgccggggtcccccggccgcggtccgcagctgcgcctcgtcgcatgctcatacgatggcgccgacgacgaagctgtggacgggcgtggagggcgcttcccggtcgaagagggagcctcgtagtggggtgtgggccgtcccggacgagaacggcggcgccttcccgaaggtcgacagggccggcggaggcgtggaacccaagttctaccgggccgacaatgtcaagttccgcgttgccgggacccgcgcgccttggtctaccttgtttttgtagagcgtcatgccgggtgtcggttggtgtatcgtcctggccccccccgttcttgtgccaagagagtgcgaggtttctccattctgctggggttgtgggggtgttcctatgggtggtgggtggtttgcgaggatcgacgggagtcacgggatgccgtccgcggggaggacagagggtgagtgtccccctgcctccagcgaacccgaaggttggtaactcctctggggcgtgtgagtgtttgtccaacgtgtcgaatggatcggttgaccttgcgcgcacggtcaataataggcactcatatggggaaagagagaagctgagggggggggccctgtttttggaaccgacaaaagggaccggagggtgcgccctctattgcccggagggtgcggttttagtgtttgttcgggccgttcgcccggcgagttcccgcc

SEQ ID NO: 36451 - protein, 72 aa, Zea mays
  misc_feature: Ceres CLONE 1420151-F
MAPTTKLWTGVEGASRSKREPRSGVWAVPDENGGAFPKVDRAGGGVEPKFYRADNVKFRVAGTRAPWSTLFL

SEQ ID NO: 36452 - DNA, 651 bp, Zea mays
  misc_feature: Ceres CLONE 1420158-F
  misc_feature: Encodes the peptide sequence at SEQ ID NO. 36453
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatccctggcggcaccgtgatcgcgctcacggtggccacccccgtgctggtgatcttcagcccggtgctgggtgccggcggcatcgcgctggcgctcatggcggccgggttcgtcacctcccgcgggctcggcgtccctgcgctgtcggtgttctcctggatgtacaagtacctgacggggaagcacccgccggccgccgaacagctggaccaccgcaaagccgagggctgccgtcaaaggccggcgacatcaaggatgcagcacagcacggcatcga

SEQ ID NO: 36453 - protein, 151 aa, Zea mays
  misc_feature: Ceres CLONE 1420158-F
  misc_feature (36)..(145): Pfam Name: Oleosin Pfam Description: Oleosin
MADHHRGATGGGGGYGDLQRGGGMHGEAQQQQKQGAMMTALKAATAATFGGSMLVLSGLIPGGTVIALTVATPVLVIFSPVLGAGGIALALMAAGFVTSRGLGVPALSVFSWMYKYLTGKHPPAAEQLDHRKAEGCRQRPATSRMQHSTAS

SEQ ID NO: 36454 - DNA, 793 bp, Zea mays
  misc_feature: Ceres CLONE 1420174-F
  misc_feature: Encodes the peptide sequence at SEQ ID NO. 36455
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (22)..(22): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (62)..(62): n is a, c, t, g, unknown, or other
nnnnaacccggccccaaaaaancaacaaaccacagacccgctgttcnnnnnttcaaactggngctccccgcggtggcggccgctctataactagtgcatcccccgggctgctcgagttctgcccagagcgatacctacgacatcggaccctacagaccgatcatccgccccgactactttgtcttctgacagtctggcgcggggaacaactggggcaagggccactacacacagggcgcaaagctcattgactccgtgcttgacgttgtcagaaaggaggctgagaactgcgactgcctccaaggcttccaagtctgccattcccttggaggaggcactggatctggaatgagcacagttctcatttgaaagatcagagaggagtaccctgatcggatgatgctgacattttctgtctttccctcgcccaaggtgtcagacactgttgttgacccataccatgcacccctgtcttgtccatcaagtgggtgagaacggtgatgaaagcattgactcttgacgaccgagcgcattgatgacttttgcttcccaaactggtaaaagtggacgaacccctagcttttcggagacctggaaaccccttgatccccggcgacggatgaagtgcgcgaacacctggcttgccccccggcgttcccatggacgcacttaagattcctcgaacctggcgcaaagccttgacaggtcttaccctggcacccccgattccctcacggattccaaccttcattccattgggccgggcaaattgcccgccagtgtcgctcctcga

SEQ ID NO: 36455 - protein, 31 aa, Zea mays
  misc_feature: Ceres CLONE 1420174-F
MMLTFSVFPSPKVSDTVVDPYHAPLSCPSSG

SEQ ID NO: 36456 - DNA, 650 bp, Zea mays
  misc_feature: Ceres CLONE 1420180-F
  misc_feature: Encodes the peptide sequence at SEQ ID NO. 36457
  misc_feature (444)..(444): n is a, c, t, g, unknown, or other
aagctggagctccccgcggtggcggccgctctagaactagtggatcccccgggctgcaggaattcgcacgagaccattacctagaacatcctaatcgaaaatttttcgacaacgccaaacatctggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcaggnagggtcttgctcttttgtgatcatccatgcctcttggaaaaagagaaacccaatcattgttcagtgctgatgctatttctcgagcaaagcagattctggcaactattcctggacgggcaacaggtgcatatagtcacagtcagggtatcaaaaggatgcttgatgcaatggctgctgggatcacctcagtgacggattccctgcaa

SEQ ID NO: 36457 - protein, 74 aa, Zea mays
  misc_feature: Ceres CLONE 1420180-F
  misc_feature: SWISSPROT Homolog: EC 2.6.1.2 Alanine transaminase
  misc_feature (69)..(69): Xaa is any aa, unknown, or other
MAPSVAVENLNPKVLKCEYAVRGEIVIHAQRLQQQLQTQPGSLPFDEILFCNIGNPQSLGQQPVTFFRXGLALL

SEQ ID NO: 36458 - DNA, 636 bp, Zea mays
  misc_feature: Ceres CLONE 1420194-F
  misc_feature: Encodes the peptide sequence at SEQ ID NO. 36459
aaagctggagctccccgcggtggcggccgctctagaactagtggatcccccgggctgcaggaattcgcacgagaccattacctagaacatcctaatcgaaaaaacaacgaacaaaaaaactctactccgtaacctttccgtctctaaccttcccgtctcctgctgccacctcccgcatccgtgaagaacgactgaaccagccgccacccgcccgtccgactccggctccggccacctgcctccgtccctccgccgagctgcccgtctgccttcgtccctccggcctaggcgagcagatctccacccccacccgccccgagccgagcagcagccagcagagccgcatcgccgccggggaacgctgagttgccggcccgtcgccctgagaagatctccatcccagcagcatagccgcagcgccgcctccccaaggcaaggcccgagcgccctacgccctgccacaggccccagattaggttgatgtctttcatgagactattgcctcaaaggctaccccaacttatcaggcaggtggagcaagatgttgagactgtaatccacgttctccagccaggtccaataggaattgtggagcacaaatcacagacacggagatcttagaggccagggctacag

SEQ ID NO: 36459 - protein, 46 aa, Zea mays
  misc_feature: Ceres CLONE 1420194-F
MSFMRLLPQRLPQLIRQVEQDVETVIHVLQPGPIGIVEHKSQTRRS

SEQ ID NO: 36460 - DNA, 752 bp, Zea mays
  misc_feature: Ceres CLONE 1420195-F
  misc_feature: Encodes the peptide sequence at SEQ ID NO. 36461
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
nggggggggnnnnnnccggcaccccccccccgcggcaccctccaaaaggggaaacaaaaaagaactcaccgcggtggagggcgcgccgttcctaaaagatggggggggctgcaagattccccacgacaccagtagctagaacatcctaacgaaaaacgacggccgcctcgtgcagcgcccgacgccgctcgtcgcgctcgtcaccttcctctggatgccgttcggcttcgcgctggcgctcatgcgcgtgtacatcaacctgccgctgcccgagcgcatcgtctactacacctacaagctcatgggcatcaggctcgtcgtttagggcaccccgtcgccgccgcccaagaagggccacccgggcgtcctcttcgtctgcaaccaccgcaccgtgctcgaccccgtcgaggtggccgtggctctgcgccgcaagggggggtgcgtcacctacagcatctccgagttccccgagctcatctcggccatcaagggcatcgcgctgacgtcggagcgcgacaagggacggcaagaaccgtccgccgcctggtgggaggaagggcgacctgggccatactgcccccgaaggggcaccacactggccgaaaaggaccatccgatggctggcagcagtaagggggaggtgttggggggggaggcgccagcgcgcaccggcggtcggaggcgccggtgggggccctcccacccacccacagggagagaccctggggtcgccaagggggcatccgcccccg

SEQ ID NO: 36461 - protein, 36 aa, Zea mays
  misc_feature: Ceres CLONE 1420195-F
  misc_feature: SWISSPROT Homolog: EC 2.3.1.15 Glycerol-3-phosphate O-acyltransferase
MPFGFALALMRVYINLPLPERIVYYTYKLMGIRLVV

SEQ ID NO: 36462 - DNA, 652 bp, Zea mays
  misc_feature: Ceres CLONE 1420197-F
  misc_feature: Encodes the peptide sequence at SEQ ID NO. 36463
atagctggagctccccgcggtggcggccgctctagatctagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgctggccgccgaggaacagctgcggcagctgcgcgcgcgccgccgcgaggacgcccgcgcaaagcccgcgccgccgagatcctcgcggggccacgccgcccctggatggaggcccagcgccccctggagggccgcgccggccgcgccgggggaaaaagccgcttcccttcgggggcaccttcccaaagccaagggccaagccgttgctcttggcgcccgcgcccaagcagatctaggcccgaggccccccaaaggggaataacctgc

SEQ ID NO: 36463 - protein, 154 aa, Zea mays
  misc_feature: Ceres CLONE 1420197-F
MAAESARPPSPPRDSGCPAGAGDSTSSQLTATYLGVSFALFLATLPSGTAARHVASLQSRGRLLASRLLAAEEQLRQLRARRREDARAKPAPPRSSRGHAAPGWRPSAPWRAAPAAPGEKAASLRGHLPKAKGQAVALGARAQADLGPRPPKGE

SEQ ID NO: 36464 - DNA, 646 bp, Zea mays
  misc_feature: Ceres CLONE 1420199-F
  misc_feature: Encodes the peptide sequence at SEQ ID NO. 36465
aaagctggagctccccgcggtggcggccgctctagaactagtggatcccccgggctgcaggaattcgcacgagaccattacctagaacatcctaatcgaaaagcactgaatctgtaacctctcgtgtagagttcgcgtcggaatctgacctgttttattgctggatgccgcagtggcggagctgtggtcggcggcgaagagcgcgcctcccctggccgtgctcgcgggtgtggcggcggcggtggcgatatacaaggtcgggtccagtctccttgcgccgcgccatcccccgccccgtcggctggaggcccagacggccccgccgcctccagtcccggagccggtgcaggtgggcgagataacggaggaggaactacggcagtacgacgggtccgaccccgagaaaccgctgctgatggccatcaaggggcagatctatgacgtctcagagagcaggatgttctatggacctggcgcagcttatgctctgtttgctggtaaagatgcccagtaggcattggctaagatgtccttttgatcacagatctgaatggtgatatatctggtctaacgccatggagctcggcgcttggatgactgggagtaccagtcgcccaccagatgcgaaagtaggaccattagaagg

SEQ ID NO: 36465 - protein, 32 aa, Zea mays
  misc_feature: Ceres CLONE 1420199-F
MAIKGQIYDVSESRMFYGPGAAYALFAGKDAQ

SEQ ID NO: 36466 - DNA, 695 bp, Zea mays
  misc_feature: Ceres CLONE 1420207-F
  misc_feature: Encodes the peptide sequence at SEQ ID NO. 36467
  misc_feature (690)..(690): n is a, c, t, g, unknown, or other
  misc_feature (695)..(695): n is a, c, t, g, unknown, or other
gctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctggaagctccagttgttgttgttacaggtgcctctagagggattggaaaggcaactgctctagcccttggaaaagcaggatgcaaggttctggtaaattatgctcggtcttcgaaagaggctgaagaggtctccaaagagattgaagcatctggtggtgaggctatcacctttggaggagatgtttcaaaagaagctgatgtagagtctatgatgaaagcagctctagataaatggggaacgatagatgtgctggtaaataatgcangaatn

SEQ ID NO: 36467 - protein, 158 aa, Zea mays
  misc_feature: Ceres CLONE 1420207-F
  misc_feature: SWISSPROT Homolog: EC 1.1.1.100 3-oxoacyl-[acyl-carrier-protein] reductase
MAAAAAAAAAVSSPIAPRAVAAAASRRGFVTFGGGAARSSPTLRSGRGFSGVQTHVAAVEQAVVKDATKLEAPVVVVTGASRGIGKATALALGKAGCKVLVNYARSSKEAEEVSKEIEASGGEAITFGGDVSKEADVESMMKAALDKWGTIDVLVNNA

SEQ ID NO: 36468 - DNA, 667 bp, Zea mays
  misc_feature: Ceres CLONE 1420214-F
  misc_feature: Encodes the peptide sequence at SEQ ID NO. 36469
atagctggagctccccgcggtggcggccgctctagaactagtggatcccccgggctgcaggaattcgcacgagaccattacctagaacatcctaatcgaaaaagaaacacacatgggcgacggggctccgccgccaggggctctatactccttcagaacgccgtggccggagctcaatcaaggcctcacctacaccgacacgttccgttgcgctgatgcggactccgctaccaccttgattgaattctactctactaaccaccagacctcggagccgttgccaccgcggatcaagaggattcgtaatgggcatataaccgttgatggtgaagttgtcactgatacacatctaactctggtagatggatctcaattggtatatcatctactaccttggcaagagccatttgcaccacatttgctggaagtgctctacgaagatgatgacttgtctgctcttaataagccttctggcttgccagctctgccgacaggactgttacatcagcgaactgttttaccacagcttcaattgaaagactggaagatggcctcatcttgccggatcaacagcaaagatgtgcagacacatccagtacctgttcatcgtttatggaggggtacatcaagcctcctgctttgtgcctagacaaaagttgccaaagtt

SEQ ID NO: 36469 - protein, 178 aa, Zea mays
  misc_feature: Ceres CLONE 1420214-F
MGDGAPPPGALYSFRTPWPELNQGLTYTDTFRCADADSATTLIEFYSTNHQTSEPLPPRIKRIRNGHITVDGEVVTDTHLTLVDGSQLVYHLLPWQEPFAPHLLEVLYEDDDLSALNKPSGLPALPTGLLHQRTVLPQLQLKDWKMASSCRINSKDVQTHPVPVHRLWRGTSSLLLCA

SEQ ID NO: 36470 - DNA, 668 bp, Zea mays
  misc_feature: Ceres CLONE 1420215-F
  misc_feature: Translation starting site: 283
  misc_feature (407)..(407): n is a, c, t, g, unknown, or other
  misc_feature (408)..(408): n is a, c, t, g, unknown, or other
  misc_feature (410)..(410): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (418)..(418): n is a, c, t, g, unknown, or other
  misc_feature (422)..(422): n is a, c, t, g, unknown, or other
  misc_feature (426)..(426): n is a, c, t, g, unknown, or other
  misc_feature (434)..(434): n is a, c, t, g, unknown, or other
  misc_feature (436)..(436): n is a, c, t, g, unknown, or other
  misc_feature (437)..(437): n is a, c, t, g, unknown, or other
  misc_feature (439)..(439): n is a, c, t, g, unknown, or other
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccataggcttgctaaaggtatgggnntnannnnaangacnaaangactgggngnngnnaaatttgggatatcggggacaaaggtagcaatggaacaaaggggggatgcaacagtccccctataggaaccccatggctggcttccagcgctggggaaatgggttcaataacagggatttccctggggaaaccccatttccgggtccccttaccttggatccaaaagcgaaaaatgcctttccaataacccccccagttttgacactccttgggggggggttggaaag

SEQ ID NO: 36471 - DNA, 492 bp, Zea mays
  misc_feature: Ceres CLONE 1420221-F
  misc_feature: Encodes the peptide sequence at SEQ ID NO. 36472
aagctggagctccccgcggtggcggccgctctagaactagtggatcccccgggctgcaggaattcgcacgagaccattacctagaacatcctaatcgaaaaaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacacgccaagctgccctccttctatgatgaagtaaggatgtgggtgttttgaggaaatactgcctaacaggcaggaagctatctgagttcctttaacaaacagaatgggaacctgcaaaatactttcccagggattaaacctttggaaacaaaatgttttttgcccaaccccctat

SEQ ID NO: 36472 - protein, 41 aa, Zea mays
  misc_feature: Ceres CLONE 1420221-F
  misc_feature: SWISSPROT Homolog: EC 1.1.1.8 Glycerol-3-phosphate dehydrogenase (NAD(+))
MEMENGHAKYRVAVIGSGNWGSVASRLIASNTPSCPPSMMK

SEQ ID NO: 36473 - DNA, 634 bp, Zea mays
  misc_feature: Ceres CLONE 1420225-F
  misc_feature: Encodes the peptide sequence at SEQ ID NO. 36474
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaactctcttcgctcagctcccacaagaaagggcgaagaatctctccctcctccttgaccttctcttcgccatcgattccctttgaggtgcaaaaatggttgaacagactcagcaacaaccctcgattctccagaaggcttcttctggccagctcatgcgctccggggtttctcaggacatccatggctacgcatctggtttccagaggcgtgcgacctacggaaactactcgaacgctgcgtttcagtaccctctcgcggcctcttccaggattgtggcgactactactacttctcctgtttttgtgcaagctccaagtgagaaaggattctctagcttcgctattgatttcttgatgggtggtgtttccgctgctgtctctaagaccgcggctgctcccattgagcggtgtgaagcttttgattcagaaccaggatgagatgcttaagggctggtgggttatctgagccttacaagggtattggtggatggtttcggaaggactattaaggaataaagggttggggtcctttn

SEQ ID NO: 36474 - protein, 114 aa, Zea mays
  misc_feature: Ceres CLONE 1420225-F
MVEQTQQQPSILQKASSGQLMRSGVSQDIHGYASGFQRRATYGNYSNAAFQYPLAASSRIVATTTTSPVFVQAPSEKGFSSFAIDFLMGGVSAAVSKTAAAPIERCEAFDSEPG

SEQ ID NO: 36475 - DNA, 664 bp, Zea mays
  misc_feature: Ceres CLONE 1420226-F
aaagctggagctccccgcggtggcggccgctctagaactagtggatcccccgggctgcaggaattcgcacgagaccattacctagaacatcctaatcgaaaactcctgaacacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggccatcgtggccgtccgcgcgccgccgcgtgggcgtgcctgggccgcccctcgagaagccgccgcgcgccgcttgctgcgccagagtcccgacggcgaggctcgcggtcgccggcgacaggccccggaagctggtgctgctgggcgcccatacccggagggccgcggatccctgccttcgttggcccccccaatctgcaagaacagggaagggccactactccgctgaataagcctctcttactacagacaaaaagcccaagaaagttcctgccttaacttggatgccccgttgcgctttttc

SEQ ID NO: 36476 - DNA, 770 bp, Zea mays
  misc_feature: Ceres CLONE 1420232-F
  misc_feature: Translation starting site: 258
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ggggnggggnnggggggnnnggggtggaagggggnnnagggggtcaannnnccaagctgggactccccgcggtggcggccgctctagaactagtggatcccccgggctgcaggaattcgcacgagaccattacctagaacatcctaatcgaaaaaactactccgccactatgtttgcgaagctcctcctcgatccatcgatcactgcaacggtcggcggtaccgcgcttgcaggggctagccaacgagacggtagcgatggaggaccgcgagcgcggcggcatctacggcggcgcccacgccacctgcgggcagcagcaacaccagggaggaggccggcgcccgatgggtgagcgggtgaagggcatgctccacgacaaggggccgacggcgtctcaggcgctgactgaggtgacgctgttcccgctgggcgggcctgctgctggtgatgtacgggctggcgcttactgcctccgaggtggggctggccggggccacgcaggtgttcactgatcttcagccccgtgctcttccgcgccgcgctgctccatcaggacggacgtcaaggggttcctcaattcgggccgcgcgtgggctccgggggcctgtcggtcgatcgcggggcctcggcccatgcgtggcgcgggagggaggtttcgacggaacacccccgggaattgaagttgggggggagggtcccctccctcctagcaatgggcccggataggcccggcaggtgatacacgggctgggccccaccctatatacccg

SEQ ID NO: 36477 - DNA, 725 bp, Zea mays
  misc_feature: Ceres CLONE 1420238-F
  misc_feature: Encodes the peptide sequence at SEQ ID NO. 36478
  misc_feature (613)..(613): n is a, c, t, g, unknown, or other
  misc_feature (702)..(702): n is a, c, t, g, unknown, or other
  misc_feature (725)..(725): n is a, c, t, g, unknown, or other
tccccgcggtggcggccgctctagatctagtggatcccccgggctgcaggaattctcacgagaccattacctagaacatcctaatcgaaaaatcaaccaaaccctctaatccatttcggcatttccaacgccttcgccctaccagccacgtcgcttcgaggccgatcgaccgagcagctggtggcaatggcggcggcggcggaggtcgtgctgctggacttctgggtgagccccttcgggcagcgctgccggatcgcgctggcggagaagggcgtggcctacgagtaccgcgagcaggacctcctggacaagggcgagctgctcctccgctccaaccccatccacaagaagatccccgtcctgctccacgccggcaggcccgtctgcgagtcgctcgtcatcctccagtacatcgacgaggcctggccggacgtcgcgccgctcctccccaaggacgacccctacgcccgcgcgcaggcgcgtttctgggcccgattcctcgacaagaagatctatgacagccagactccgcctgggaaattctagggggaagggcgggaacaggggaaagaaggacctggtggaggtcctgggagaccttgggaggggaggntcgcccagcaagccctttcttgggggggggggccctctggcttccccggactcgggctcgtggggcccttcccgtgcctgggtccctcngccatagaaaaacctgggggggn

SEQ ID NO: 36478 - protein, 119 aa, Zea mays
  misc_feature: Ceres CLONE 1420238-F
  misc_feature (5)..(78): Pfam Name: GST_N Pfam Description: Glutathione S-transferase, N-terminal domain
  misc_feature: SWISSPROT Homolog: EC 4.4.1.5 Lactoylglutathione lyase
MAAAAEVVLLDFWVSPFGQRCRIALAEKGVAYEYREQDLLDKGELLLRSNPIHKKIPVLLHAGRPVCESLVILQYIDEAWPDVAPLLPKDDPYARAQARFWARFLDKKIYDSQTPPGKF

SEQ ID NO: 36479 - DNA, 653 bp, Zea mays
  misc_feature: Ceres CLONE 1420239-F
ggagctccccgcggtggcggccgctctagaactagtggatcccccgggctgcaggaattcgcacgagaccattacctagaacatcctaatcgaaaaacaaacccaacttccaccagacccctaaccttttcgcagctccagcgcacagccgccgccgtttcttcatcttcttcgcagagccggcgctccatcttcggctccctcccttacttgcgctcggcacgcaggcggcgctgtggctcgggatctcagtgacggcatcaagggcttcccctcccgcctctcgccagtcgcctccggtcctccgcacaccggccggtgatctctctcctcccgcctccggtggatcgtcaacggcgcccggccccggcggctgcgtcgcgcgcgtcctgagggcagctgcaggcgctgctcgactaaggcggtcgcgccgctttgggagcggtttatgccccaaagtgaagcgtgctcttagtgcccgctcttggaaccctggtaatggctactgctgttaaatggctcaaccttcagtcattctagcaactgcaagttatgatcacacaatcagattttggggaagccaagagcggtcgctgttaccgcactattcagtatccagactctcaagttaaatcgccttgagataaccctga

SEQ ID NO: 36480 - DNA, 649 bp, Zea mays
  misc_feature: Ceres CLONE 1420243-F
  misc_feature: Encodes the peptide sequence at SEQ ID NO. 36481
  misc_feature (538)..(538): n is a, c, t, g, unknown, or other
  misc_feature (539)..(539): n is a, c, t, g, unknown, or other
  misc_feature (560)..(560): n is a, c, t, g, unknown, or other
  misc_feature (614)..(614): n is a, c, t, g, unknown, or other
  misc_feature (649)..(649): n is a, c, t, g, unknown, or other
ggagctccccgcggtggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaannacatggagctaaattggtcangcaagctgcagctaagaacaacgatcttgctggggagatggacaccacctctgntgtccttgctcaagggctgattgctgagggtgttn

SEQ ID NO: 36481 - protein, 138 aa, Zea mays
  misc_feature: Ceres CLONE 1420243-F
  misc_feature (102)..(102): Xaa is any aa, unknown, or other
  misc_feature (109)..(109): Xaa is any aa, unknown, or other
  misc_feature (127)..(127): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVEXHGAKLVXQAAAKNNDLAGEMDTTSXVLAQGLIAEGV

SEQ ID NO: 36482 - DNA, 710 bp, Zea mays
  misc_feature: Ceres CLONE 1420254-F
  misc_feature: Encodes the peptide sequence at SEQ ID NO. 36483
  misc_feature (528)..(528): n is a, c, t, g, unknown, or other
  misc_feature (529)..(529): n is a, c, t, g, unknown, or other
  misc_feature (670)..(670): n is a, c, t, g, unknown, or other
  misc_feature (688)..(688): n is a, c, t, g, unknown, or other
caaagctggagctccccgcggtggcggccgctctagaactagtggatcccccgggctgcaggaattcgcacgagaccattacctagaacatcctaatcgaaaacggttccggatccgaatctcgccctcccctctctttcttgcctccaggtccggccgtccgggcggcgccgggaggagagaatggcctccacggcgtcgccgccggtgttcgagagggtggccgggatccgagccattgccgagtccggccgcttcaaggcatggttgctggaccagtttggcgttcttcatgacgggaagaagccgtaccccggcgccattctggcattggagaagctagcggagaatggggcaaagatggtgataatcagcaattcctctaggcggtcatctgtgacaatgaagaagctcaagagcctggggttcgacacgtcctgtttcctcgcgaccatcaccagtggggagctcagacatcacccccttcagaagagagacgacccatgcccccccccctcttgcaaagannttttttccgtttcgccttggggacgatcggaggcggcaattgttcttcgaagggcccttggttcttgaaagtttgtcaaccaatggttcgatgatgagcgaaaggcgtaatttaacgcccccgtggaaccgaaaaacgccnttgggcccccgcgtgtcnaggcggagtcccttccgttccc

SEQ ID NO: 36483 - protein, 137 aa, Zea mays
  misc_feature: Ceres CLONE 1420254-F
  misc_feature (115)..(115): Xaa is any aa, unknown, or other
  misc_feature (116)..(116): Xaa is any aa, unknown, or other
MASTASPPVFERVAGIRAIAESGRFKAWLLDQFGVLHDGKKPYPGAILALEKLAENGAKMVIISNSSRRSSVTMKKLKSLGFDTSCFLATITSGELRHHPLQKRDDPCPPPSCKXXFSVSPWGRSEAAIVLRRALGS

SEQ ID NO: 36484 - DNA, 669 bp, Zea mays
  misc_feature: Ceres CLONE 1420267-F
  misc_feature: Encodes the peptide sequence at SEQ ID NO. 36485
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgaccgcgggcgtggacccctacttctccccttcccggaggggcgaagggccggccaatgccttggcccccccagggccacccgggggaaacccagaatggctgaaggggggccccccccccggaatggcctccaaatgggaacaaaaataaggtccgggcccaaaaggccggggaaattccccggaaaaggggaaaaccccacccccgggggaagggggg

SEQ ID NO: 36485 - protein, 153 aa, Zea mays
  misc_feature: Ceres CLONE 1420267-F
MGKGSVGASWWAFLLLAGVLLVVAATAGAEDGVVERDRKEDLRWCKQACEWQYGKDTPRKRECESECRERHQQADAGEDGDRGRGPLLLPFPEGRRAGQCLGPPRATRGKPRMAEGGPPPRNGLQMGTKIRSGPKRPGKFPGKGENPTPGGRG

SEQ ID NO: 36486 - DNA, 645 bp, Zea mays
  misc_feature: Ceres CLONE 1420269-F
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctccctggtgctcaaacctcatcatggtacatcatccgtccatccggctttcgccaagctggaaacctgaaaccccctttttttcaaagggggggaaaacaaaaaatccccccccggggtgtggggcgagaaaaaaaaaggggggacccatttttaactctccctgggggggggggccccccacacacccccccgcgggggtggttggggggcgccccccccccacaacaaaaaataaaatnggtgtttcccccccccccccccccccc

SEQ ID NO: 36487 - DNA, 694 bp, Zea mays
  misc_feature: Ceres CLONE 1420270-F
  misc_feature: Encodes the peptide sequence at SEQ ID NO. 36488
  misc_feature (36)..(36): n is a, c, t, g, unknown, or other
  misc_feature (42)..(42): n is a, c, t, g, unknown, or other
  misc_feature (44)..(44): n is a, c, t, g, unknown, or other
  misc_feature (612)..(612): n is a, c, t, g, unknown, or other
tccccgcggtggcggccgctctagaactagtggatnccccgngnctgcaggaattcgcacgagaccattacctagaacatcctaatcgaaaaatctcccataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacaggttcctccccaccaattttcctttcaatgggggctttcgaaacatccccggcccctgggcaaggccctccggggggttataaattttacgctttggggggggagggcccttttaacaacacacttttgggcccattttggaacaaaaaatttttttggggacttttttaaccctcttaaaaacgcttgtgggggggggaacacaaaaaaaacaaaaaattttttcctcccacctctgggggtccccctctcctgcggggggtgaaacgttttgccccccccttttggccaaacccctctttttttggtttacaacccccccacttttgtcgggggggtagnaaaatgttgggtggctcgccatagaaaacgcaacgggtttgaaaaatttgtttgttgcggcggtttcttccaataaaaacgg

SEQ ID NO: 36488 - protein, 124 aa, Zea mays
  misc_feature: Ceres CLONE 1420270-F
MATKILALLALLALLVSATNAFIIPQCSLAPSASIPQVPPHQFSFQWGLSKHPRPLGKALRGVINFTLWGGRALLTTHFWAHFGTKNFFGDFFNPLKNACGGGNTKKTKNFFLPPLGVPLSCGG

SEQ ID NO: 36489 - DNA, 812 bp, Zea mays
  misc_feature: Ceres CLONE 1420271-F
  misc_feature (529)..(529): n is a, c, t, g, unknown, or other
  misc_feature (744)..(744): n is a, c, t, g, unknown, or other
caagctggagctccccgcggtggcggccgctctagaactagtggatcccccgggctgcaggaattcgcacgagaccattacctagaacatcctaatcgaaaactccaagaccaagacgaacaccactccactccctccatttccctcacctcccgcagcagctagccgccagccaacaaccgaaccaaccaaccaacccacaggccacagcgagcgagtaaagcgtccaatggtagcgatggcggccgtgtatcagcagcagcagcaccaatgccgtgacgagaaggcgcaactgaacctgcccccgggcttacgcttagaaccgatggtcgcaggagatggacgggaaccgagctggagcattgttgtcattgcgaaggatatctccacaggcggggggagcaagcaagggcgagaattaggacccccttgaacagtgagacaccgggggaggaacgagagaattcataacgcacccctcacaccacaaaagctcgccccctttaccggataagtttaaaataaaaanattggtaaaccgaaaaaggtattttaccccaccccccgaagaacaacacggggtggggggaaggtttggagaggaacaacctcttgagataaacaccaagatcggcacttgggactaccaacaacaacccccggctgatttgctttctcaacaccacaaacaggccggagaaagagcaagaccgcacaacgcatgtataggccgcgtctgggggntatactagttccacaacagacgaaatactaggcgcgccacacgaacacgacaaccccccgcatttcat

SEQ ID NO: 36490 - DNA, 678 bp, Zea mays
  misc_feature: Ceres CLONE 1420279-F
  misc_feature: Encodes the peptide sequence at SEQ ID NO. 36491
  misc_feature (131)..(131): n is a, c, t, g, unknown, or other
  misc_feature (132)..(132): n is a, c, t, g, unknown, or other
  misc_feature (579)..(579): n is a, c, t, g, unknown, or other
aaagctggagctccccgcggtggcggccgctctagaactagtggatcccccgggctgcaggaattcgcacgagaccattacctagaacatcctaatcgaaaaaaataaatgcccatgcaacatctacacanngatgggtgatttgaaagaatttgaagctctcaaccgttgttttggccagaatcctcagctacgagtgaactcaacaaagtcgatgacaggccatctgctaggagctgctggtggaatagaggctgttgctgctatacaagctataaggacaggttgggtgcatccaaatctcaatttggacaatccagagaaaaccgtggatgtcaggatgctggtgggcccgcagaaggagagatgtgatgtgaaggtggcgctgtcgaactcgtttggatttggcgggcacaactcatcgattttgtttgcaccattcaagtgatagccgttgacaaatttcttgtggtgggctacacaccgtcgaactgagaccttgtataagaaagtatttaccggacgcagcaatatctccctgtactgcaagatttaggaagagatcccaaaaggcttaantaaggaagtgtattttgccccccacccgggcaaaaaaaggaaaatgggccaaaattttccacccaaaaggggtcttttaaaacccccccccccttttgt

SEQ ID NO: 36491 - protein, 104 aa, Zea mays
  misc_feature: Ceres CLONE 1420279-F
  misc_feature (2)..(60): Pfam Name: Ketoacyl-synt_C Pfam Description: Beta-ketoacyl synthase, C-terminal domain
  misc_feature: SWISSPROT Homolog: EC 2.3.1.41 Beta-ketoacyl-acyl-carrier-protein synthase I
MGDLKEFEALNRCFGQNPQLRVNSTKSMTGHLLGAAGGIEAVAAIQAIRTGWVHPNLNLDNPEKTVDVRMLVGPQKERCDVKVALSNSFGFGGHNSSILFAPFK

SEQ ID NO: 36492 - DNA, 838 bp, Zea mays
  misc_feature: Ceres CLONE 1420282-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (28)..(28): n is a, c, t, g, unknown, or other
  misc_feature (29)..(29): n is a, c, t, g, unknown, or other
  misc_feature (38)..(38): n is a, c, t, g, unknown, or other
  misc_feature (51)..(51): n is a, c, t, g, unknown, or other
  misc_feature (838)..(838): n is a, c, t, g, unknown, or other
nnnnnccccccccccccccccccacaannagaaagaanatgattttttttnttttaaactggggctccccgcggtggcggccgctctagaactagtggatcccccgggctgcaggaattcgcacgagaccattacctagaacatcctaatcgaaaaaccgccggtcaagtccctgatggacacgccgccgccctctctcccgccgtccaccctcctctggccggacctcctcgcgggcgcggcgtcctccacctgccgcctcggcgccgcgcattcccgtcacttcctggccctatcctctctcctccttctcccgctcgccctcctcctactcgccctcccctgcccgttcttctctgcctccgcctcctccggcgcctcccctccctgacatctccggggcccgcaggatcccgcaaggtacctactaaccagtccggctgcgcgctggttcgccccttggccggcgccccccctcctagccttaggcggccttttcccaccccgcccgcggggcctaggggcgcgacggcgaggggtgccgtttcgcggtccggctccgtttcggggggctccctagagcctgtcgcgtccgggttgcgccgggcccccccctccattcgcgtcccccgtctcattcccctgaacccgcccaatcggtgaggcttcgccgggggtgggggtcttgctgtgtcgtttctttttgtcgttttccccggggggggggggggggggagcatacactgggctgggtgcgtgcgggaaatggtggcggtgttggggtcccgcgttgcgggggccccccttccccggcgacccccgccctcgattgcactan

SEQ ID NO: 36493 - DNA, 629 bp, Zea mays
  misc_feature: Ceres CLONE 1420284-F
  misc_feature: Encodes the peptide sequence at SEQ ID NO. 36494
  misc_feature (340)..(340): n is a, c, t, g, unknown, or other
  misc_feature (350)..(350): n is a, c, t, g, unknown, or other
ggagctccccgcggtggcggccgctctagaactagtggatcccccgggctgcaggaattcgcacgagaccattacctagaacatcctaatccaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgcntcctacatcngcccctcggctcctacccagcttgggggatcacgggatcgattcgcagccgtacctctttaggccggaactcctcccctttccctccgggacaagggggggggtttctccccctcccgggagggggtggagggggtttccattgggaacacccggttcccggtgatcggggaattttttttttgcggggaggggacccagggggtgttcccccccccccccctgtgagaaatttgggttttccccccttaggggccccccttttttcaaaggggggggc

SEQ ID NO: 36494 - protein, 141 aa, Zea mays
  misc_feature: Ceres CLONE 1420284-F
  misc_feature (46)..(46): Xaa is any aa, unknown, or other
  misc_feature (49)..(49): Xaa is any aa, unknown, or other
MASPDLLFNLRNLFYLGAYQAAINNSDVPGLDADAAAERDAIVFRXLHXPLGSYPAWGITGSIRSRTSLGRNSSPFPPGQGGGFLPLPGGGGGGFHWEHPVPGDRGIFFLRGGDPGGVPPPPPVRNLGFPPLGAPLFSKGG

SEQ ID NO: 36495 - DNA, 685 bp, Zea mays
  misc_feature: Ceres CLONE 1420291-F
  misc_feature: Encodes the peptide sequence at SEQ ID NO. 36496
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccacagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaataatggccggaattggcaggaacatggtggcgccgctcctggtgctcaacctcatcatgtacatcatcgtcatcggcttcgcgagctggaacctgaaccacttcatcaacgggcagaccaactaccccgacgtgaccggaaacggcacgacgttctactttcctgatgttcgccatcctggccggaggtggtgggggcggccttccagctggcgggcggtgtaccaagtgcgcaccttggcgccacaaacacctggacaacaacccccgcgtcgatcctcatctcctggggcattacggcccctcgccttcagggctggcctgcaagggaaatccccatcggcgg

SEQ ID NO: 36496 - protein, 114 aa, Zea mays
  misc_feature: Ceres CLONE 1420291-F
MAGIGRNMVAPLLVLNLIMYIIVIGFASWNLNHFINGQTNYPDVTGNGTTFYFPDVRHPGRRWWGRPSSWRAVYQVRTLAPQTPGQQPPRRSSSPGALRPLAFRAGLQGKSPSA

SEQ ID NO: 36497 - DNA, 641 bp, Zea mays
  misc_feature: Ceres CLONE 1420294-F
  misc_feature: Encodes the peptide sequence at SEQ ID NO. 36498
  misc_feature (641)..(641): n is a, c, t, g, unknown, or other
ctggagctccccgcggtggcggccgctctagaactagtggatcccccgggctgcaggaattcgcacgagaccattacctagaacatcctaatcgaaaaaaaaaccgcaccgcaccgcaacgcgccaccgatccaccccgcgtcctcggcctccctccctccggcgagcggcggcgcgggcggccatggaggtgttctactacgtcgtgttcggcgcgctggccgccatcgtggcggggctcgagctcggcaagagcggcaaggaccgcgtcgccactacctccgcctttaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctccatgctcttcggcaccatcgtcggctccctcgccgacaaacaaggccgcaagagggcctgcatcacctactgcatcagctacatcctcagctgcatcaccaagcactcccccgagtacagggtcctcatgatcggccgcatcctcggaggcatcgccacctcgctgctcttctccgccttcgagtcctggctcgtcgcagagn

SEQ ID NO: 36498 - protein, 152 aa, Zea mays
  misc_feature: Ceres CLONE 1420294-F
  misc_feature (4)..(152): Pfam Name: DUF791 Pfam Description: Protein of unknown function (DUF791)
MEVFYYVVFGALAAIVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAE

SEQ ID NO: 36499 - DNA, 704 bp, Zea mays
  misc_feature: Ceres CLONE 1420303-F
  misc_feature: Encodes the peptide sequence at SEQ ID NO. 36500
tccccgcggtggcggccgctctagaactagtggatcccccgggctgcaggaattcgcacgagaccattacctagaacatcctaatcgaaaatttttttttttttttttccccacacgcgcccacctcctccggtcctcccctctagtcctctctcccgaccccacctctgccgtccgtgcgtccgtccggcaaccgcgacgcaacaatggcggccgggcgagagctggtggtgagtttcggcgagatgctgatagacttcgtgccgaccgtggcgggggtctcgctggccgaggcgccggccttcctcaaggcggccgggggcgcgcccgccaacgtcgccatcgcggtctcgcgcctcggtggcggggccgccttcgttggcaagctcggcgacgacgagttcggccgcatgctcgccgccatcctccgcgacaacggcgtcgacggcggcggcgtcgtcttcgacgcgggcgcgcgcaccgcgcttgccttcgtcaccctgcgcgccgacggcgagcgcgagttcatgttctaccgcaaccccagcgccgacatgctcctcactgccgacgagctcaacgtcgggctcatccggagggctgcggtctttcactacggatcaataagcttgattgctgagccttgccggacagcacatctccgtgccatgggaaatgccaaagaggctggtgcactgctctct

SEQ ID NO: 36500 - protein, 166 aa, Zea mays
  misc_feature: Ceres CLONE 1420303-F
  misc_feature: SWISSPROT Homolog: EC 2.7.1.4 Fructokinase
MAAGRELVVSFGEMLIDFVPTVAGVSLAEAPAFLKAAGGAPANVAIAVSRLGGGAAFVGKLGDDEFGRMLAAILRDNGVDGGGVVFDAGARTALAFVTLRADGEREFMFYRNPSADMLLTADELNVGLIRRAAVFHYGSISLIAEPCRTAHLRAMGNAKEAGALLS

SEQ ID NO: 36501 - DNA, 669 bp, Zea mays
  misc_feature: Ceres CLONE 1420337-F
  misc_feature: Encodes the peptide sequence at SEQ ID NO. 36502
aaagctggactccccgcggtggcggccgctctagaactagtggatcccccgggctgcaggaattcgcacgagaccattacctagaacatcctaatcgaaaatagaatcgtgtgcgagctggacagcaggaagagccgtagagttcgacgcgaggagcgagcgagtgattagctcgtgcgtgctgtgcaaggaaagtaacccagcagatcgatcggtcgaggcgggtaggacaggatctagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcaataccgcctcgtcctcgtcacggcaaagcccaccggcgccttcggcgttgggcctccccgggcccgggcgccccggaatttccctgccctacctggaagccggatctcaaaggcccccccccctggggcggtcgtcaaaaaaagcccaaaaggccccttgcccccaaggcgaaagcccaccccttgttttttaagcgcccttgaagggggggaaccccttaaaaaactccccccctcgcaaaggttctcttcaaagaggccccgcggc

SEQ ID NO: 36502 - protein, 139 aa, Zea mays
  misc_feature: Ceres CLONE 1420337-F
MAEEASAPAAGTEAPPGKMTMVVGVDESEHSFYALQWALQHFFPPGQPQQYRLVLVTAKPTGAFGVGPPRARAPRNFPALPGSRISKAPPPGAVVKKSPKGPLPPRRKPTPCFLSALEGGEPLKKLPPSQRFSSKRPRG

SEQ ID NO: 36503 - DNA, 552 bp, Zea mays
  misc_feature: Ceres CLONE 1420341-F
  misc_feature: Encodes the peptide sequence at SEQ ID NO. 36504
  misc_feature (282)..(282): n is a, c, t, g, unknown, or other
  misc_feature (311)..(311): n is a, c, t, g, unknown, or other
  misc_feature (365)..(365): n is a, c, t, g, unknown, or other
aagctggactccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgaccatggggaagggtagtgtgggtgcatcatggtgggcgttcctctgctcgcggcgtgctgctggtcgtagcanccacgccgggggcgaagacggagtggtcnaacgggaccgcaaggaggaccttcggtggtgcaaccaagccttccaattggcantaccgaaaggaccccccccggaaaaagggaatggcaaaacaaagtgcccccaaaggggcccacaaaaatttaacccgggggaaagaacgggaaaaggggggtggaaaccctattttttcccctccccgggaggggggaaggtgccggcccacatttcccttccccccacccagagggccacccgggg

SEQ ID NO: 36504 - protein, 113 aa, Zea mays
  misc_feature: Ceres CLONE 1420341-F
  misc_feature (24)..(24): Xaa is any aa, unknown, or other
  misc_feature (34)..(34): Xaa is any aa, unknown, or other
  misc_feature (52)..(52): Xaa is any aa, unknown, or other
MGKGSVGASWWAFLCSRRAAGRSXHAGGEDGVVXRDRKEDLRWCNQAFQLAXPKGPPPEKGNGKTKCPQRGPQKFNPGERTGKGGWKPYFFPSPGGGKVPAHISLPPTQRATR

SEQ ID NO: 36505 - DNA, 713 bp, Zea mays
  misc_feature: Ceres CLONE 1420343-F
  misc_feature: Encodes the peptide sequence at SEQ ID NO. 36506
  misc_feature (710)..(710): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgccctccacttcgacctcttcaggctgctgcggccgactggcgcgacacgctcttctgcgaggtggctccgaaccccgcgcccgcgggagagctgccggagcactcaagaacgtgatgctggagtacggcgcgncgn

SEQ ID NO: 36506 - protein, 187 aa, Zea mays
  misc_feature: Ceres CLONE 1420343-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFALHFDLFRLLRPTGATRSSARWLRTPRPRESCRSTQERDAGVRR

SEQ ID NO: 36507 - DNA, 679 bp, Zea mays
  misc_feature: Ceres CLONE 1420345-F
  misc_feature: Encodes the peptide sequence at SEQ ID NO. 36508
atagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacccgtgggaagggcaagggggcgagaacgtgagtccaaccccggcgctcgggctgctctgcttccggaaggaaaatgctgaccccccgcctggaacagaagggatggcgatattccccccccgcttctggtggctttccctggtcccgcttaaaaagggttatccaaaagga

SEQ ID NO: 36508 - protein, 127 aa, Zea mays
  misc_feature: Ceres CLONE 1420345-F
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTPVGRARGRERESNPGARAALLPEGKC

SEQ ID NO: 36509 - DNA, 683 bp, Zea mays
  misc_feature: Ceres CLONE 1420353-F
  misc_feature: Encodes the peptide sequence at SEQ ID NO. 36510
  misc_feature (608)..(608): n is a, c, t, g, unknown, or other
ggagctccccgcggtggcggccgctctagaactagtggatcccccgggctgcaggaattcgcacgagaccattacctagaacatcctaatcgaaaactctctcgctctctcgtggcttcctggcggcgactgggcgagcgccgccgccctcttcgtcgggcccgcccttcaccggcgacgtgcatccctccggagaagaatattgcgctcacataactgaataactgatattaggatgagtctctgtacaatagcacgacggctatgtctttcaaaaccatcctctggcagtcgtctttcagcaatttgggctcatctatacagcactgaggctgcaaaggacatgggtgctaagaagtacaagtactccgatgtatacgacccctacgggcctatgccgccgccttcggagatagtcgtggaactagctgatcgcatcgctgctctccctcccgaggagcatcaacagattgctccagcccttctcctcagactgaacctagagccgccacaggcgtatctggacagggtttcggtttcggtgacaaggtcagctctggggcagggtctgggaaagcgtgagaagaaagccagaagacagtcttcgnacgtcggttgggaaagttcgaccctgctgccaagatcaggatcctccggggaaacgggacgttttacggatttgg

SEQ ID NO: 36510 - protein, 149 aa, Zea mays
  misc_feature: Ceres CLONE 1420353-F
  misc_feature (125)..(125): Xaa is any aa, unknown, or other
MSLCTIARRLCLSKPSSGSRLSAIWAHLYSTEAAKDMGAKKYKYSDVYDPYGPMPPPSEIVVELADRIAALPPEEHQQIAPALLLRLNLEPPQAYLDRVSVSVTRSALGQGLGKREKKARRQSSXVGWESSTLLPRSGSSGETGRFTDL

SEQ ID NO: 36511 - DNA, 655 bp, Zea mays
  misc_feature: Ceres CLONE 1420354-F
  misc_feature: Encodes the peptide sequence at SEQ ID NO. 36512
agctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcagtctgctggatcgtattcagatgggtgatttgagcgtctgggttgtcagcggcacgccggagggcaaccggttggcggcggcaatggagctgcatcatcaggcgcaaaaggaagctatggcgccgcagcaggctcaagctccgcccccctcttcttggacttcccgcagggaggtgagcagatcgaacaaagcccaccccttggcctccccggcggaatttcgtccttcttggagcaacagcacccccaccccttctgtttccgaatttcggaaccgtgaaaaaggtcgtcccgggaaccttaatttgta

SEQ ID NO: 36512 - protein, 96 aa, Zea mays
  misc_feature: Ceres CLONE 1420354-F
MGDLSVWVVSGTPEGNRLAAAMELHHQAQKEAMAPQQAQAPPPSSWTSRREVSRSNKAHPLASPAEFRPSWSNSTPTPSVSEFRNREKGRPGNLNL

SEQ ID NO: 36513 - DNA, 658 bp, Zea mays
  misc_feature: Ceres CLONE 1420366-F
  misc_feature: Encodes the peptide sequence at SEQ ID NO. 36514
aaagctggagctccccgcggtggcggccgctctagaactagtggatcccccgggctgcaggaattcgcacgagaccattacctagaacatcctaatcgaaaaattgctctccaaccaaacctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgttttttttttttggtcctcgtcgtcgtccggactccggacaggacaggacatgggcgcggaggcggcggagcgcgacagaatcaggggcccgtggagccccgaggaggacgaggcgctgcggcggctggtggagcggcacggcacccgcaactggacggcgatcgggcgcggcgtcccgggccggtcgggcaagtcctgccacctgcggtggtgcaaccagctgtcgccaagggtggcgcgccgccccttcacggccgacgaggacgcggccatcgcccgggcccacgccccgcctcggcaaccgcggggccgccatcgcgcgcctgcttccccggccgcaccgacaaccccgtcaaaaaaccacctggaacgggctccctcaagcg

SEQ ID NO: 36514 - protein, 112 aa, Zea mays
  misc_feature: Ceres CLONE 1420366-F
  misc_feature (12)..(58): Pfam Name: Myb_DNA-binding Pfam Description: Myb-like DNA-binding domain
MGAEAAERDRIRGPWSPEEDEALRRLVERHGTRNWTAIGRGVPGRSGKSCHLRWCNQLSPRVARRPFTADEDAAIARAHAPPRQPRGRHRAPASPAAPTTPSKNHLERAPSS

SEQ ID NO: 36515 - DNA, 672 bp, Zea mays
  misc_feature: Ceres CLONE 1420367-F
  misc_feature: Encodes the peptide sequence at SEQ ID NO. 36516
atagctggagctccccgcggtggcggccgctctagaactagtggatcccccgggctgcaggaattcgcacgagaccattacctagaacatcctaatcgaaaaagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcggacgcgccacctggagccactgttcgccgcgccctccgcatctccgacctctacatctccatccgcggaagcagaccacctccaatccttctttttcacgcagtcattgcttgcctccttagcccaactgttggtaccagaggttcatgtttcatcataaggaatgaacagtagtcgacaaatggaactccactacataaacactggatttccatacccaatcaccgagagcttcatggatttctttgagggtctcacttttgctcatgctgactttgctctcacggatggctttcaggatcagggtaatccctactgggaaatgatgcatacaaactcgtacaaatatggatactctggtccctgg

SEQ ID NO: 36516 - protein, 68 aa, Zea mays
  misc_feature: Ceres CLONE 1420367-F
MNSSRQMELHYINTGFPYPITESFMDFFEGLTFAHADFALTDGFQDQGNPYWEMMHTNSYKYGYSGPW

SEQ ID NO: 36517 - DNA, 693 bp, Zea mays
  misc_feature: Ceres CLONE 1420401-F
  misc_feature: Encodes the peptide sequence at SEQ ID NO. 36518
  misc_feature (460)..(460): n is a, c, t, g, unknown, or other
  misc_feature (504)..(504): n is a, c, t, g, unknown, or other
  misc_feature (522)..(522): n is a, c, t, g, unknown, or other
  misc_feature (561)..(561): n is a, c, t, g, unknown, or other
  misc_feature (613)..(613): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagncgcgtggacgcctacgtctcccgctccgggaggggcgagtgccngcgccagtgcctgcgccngcacgagggccagccgtgggagaccccagagtgcatgangcggtgccgccgcccgcgactggccgtcgacatggagcaagagtacggtcgncgcagcgagagncgcggcaagtgccggggagagtgcgagcgcccacacccgcgggactggtgggagagcacgctgctatg

SEQ ID NO: 36518 - protein, 159 aa, Zea mays
  misc_feature: Ceres CLONE 1420401-F
  misc_feature (82)..(82): Xaa is any aa, unknown, or other
  misc_feature (97)..(97): Xaa is any aa, unknown, or other
  misc_feature (103)..(103): Xaa is any aa, unknown, or other
  misc_feature (116)..(116): Xaa is any aa, unknown, or other
  misc_feature (137)..(137): Xaa is any aa, unknown, or other
MGKGSVGASWWAFLLLAGVLLVVAATAGAEDGVVERDRKEDLRWCKQACEWQYGKDTPRKRECESECRERHQQADAGEDGDXRVDAYVSRSGRGECXRQCLRXHEGQPWETPECMXRCRRPRLAVDMEQEYGRRSEXRGKCRGECERPHPRDWWESTLL

SEQ ID NO: 36519 - DNA, 696 bp, Zea mays
  misc_feature: Ceres CLONE 1420407-F
  misc_feature: Translation starting site: 205
  misc_feature (556)..(556): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
  misc_feature (637)..(637): n is a, c, t, g, unknown, or other
  misc_feature (691)..(691): n is a, c, t, g, unknown, or other
aagctggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggcaagccagagcctgcctctgttctgccnagtggccgccgcgtgacgnnnngncgggcaggggaaggagaggctgctggtggtggtcggcggctgggacccggagacgtnggcgccgacggacgcggtgctcgtctacgacttcctgtcgggcgcgtggcggcnccgcc

SEQ ID NO: 36520 - DNA, 673 bp, Zea mays
  misc_feature: Ceres CLONE 1420410-F
  misc_feature: Encodes the peptide sequence at SEQ ID NO. 36521
  misc_feature (612)..(612): n is a, c, t, g, unknown, or other
  misc_feature (613)..(613): n is a, c, t, g, unknown, or other
  misc_feature (637)..(637): n is a, c, t, g, unknown, or other
aagctggagctccccgcggtggcggccgctctagaactagtggatcccccgggctgcaggaattcgcacgagaccattacctagaacatcctaatcggaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgccaaacacgcgcggcaggcgttccagcgcaccccggactacgnntgagaggcgcaccgcaggatggcngaagcccgcgcgcacgcggccacaaaaccgcgcagg

SEQ ID NO: 36521 - protein, 135 aa, Zea mays
  misc_feature: Ceres CLONE 1420410-F
  misc_feature (44)..(137): Pfam Name: Oleosin Pfam Description: Oleosin
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCLAKHARQAFQRTPDY

SEQ ID NO: 36522 - DNA, 675 bp, Zea mays
  misc_feature: Ceres CLONE 1420412-F
  misc_feature: Encodes the peptide sequence at SEQ ID NO. 36523
aaagctggagctccccgcggtggcggccgctctagaactagtggatcccccgggctgcaggaattcgcacgagaccattacctagaacatcctaatcgaaaacatctgcgatatatactttctcttcctcttataaacttcgaaaacaccattatagggaaacgggagattacacgatactgtgtcagacggtgagaatcccaatgaggatcttacccgagcctctaggttcggttccatgcctcattctcctcgaggcgtcggttctattttcagcgactctgtccctcgctcgtgtcgtctaagttggtggttacgccgagagcaaaatcaaatatccccatgcattcgactgactcctagtgaacattgaatgtaatgaggagaaacggcattttcttactgaaggatctggaaacattgatgactaatgaaagttcagactgaaagctcttcctcatgacattatctctgactacggagccttatatgaggagtgttatgcccagctacacactgcagcggaagcacctagtccggctcaacactgacttgactcatacaagatgctgtctctatgcacatccggagacaatcacgtttagagcctcatactacacctgaagcttacctctgaactgcgtgttccaaatcctagtgactgatccctagtac

SEQ ID NO: 36523 - protein, 33 aa, Zea mays
  misc_feature: Ceres CLONE 1420412-F
MRILPEPLGSVPCLILLEASVLFSATLSLARVV

SEQ ID NO: 36524 - DNA, 693 bp, Zea mays
  misc_feature: Ceres CLONE 1420413-F
  misc_feature: Encodes the peptide sequence at SEQ ID NO. 36525
  misc_feature (530)..(530): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (586)..(586): n is a, c, t, g, unknown, or other
ctggagctccccgcggtggcggccgctctagaactagtggatcccccgggctgcaggaattcgcacgagaccattacctagaacatcctaatcgaaaaaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgncatgaaatttttgattgccgacactgccacannntgaactagaattcccattaaantgataaaaatgagaggcatgaacttccacgccatgaagtgcagcaggttgtatgctcattgtgtgcactgaacagggagtgcgacaagtatgtatcaattgcggtgg

SEQ ID NO: 36525 - protein, 86 aa, Zea mays
  misc_feature: Ceres CLONE 1420413-F
  misc_feature (73)..(73): Xaa is any aa, unknown, or other
  misc_feature (84)..(84): Xaa is any aa, unknown, or other
  misc_feature (85)..(85): Xaa is any aa, unknown, or other
MGALDLHLDFASAQHGQAKLKEYAKSSLLSDGNYNTDKINGSNPDDYEKFEKGIMHYGCPHYRRRCRIRAPCXHEIFDCRHCHXXN

SEQ ID NO: 36526 - DNA, 672 bp, Zea mays
  misc_feature: Ceres CLONE 1420415-F
  misc_feature: Encodes the peptide sequence at SEQ ID NO. 36527
aagctggagctccccgcggtggcggccgctctagaactagtggatcccccgggctgcaggaattcgcacgagaccattacctagaacatcctaatcgaaaaaccaccaaaccaatcgctggatttgtccagagtatttccggtttcaccgccctagatctgacccgagacgccgcgtcttcgctgagatggcgattactgtgaggcggtctacgatggtgcgcccggtgcgggagaccccgcggcagcgggtgtggaactccaacctcgacctcgtggtgccgcgcttccacacgcccagtgtctacttctaccgccgcgacggccccgtgccggatgctgaggggttcttcgacggccagcggatgcggcgcgcgctggcagatgcgctcttgccgttctatccaatgccgggccgcctctcgcgggacgaggacggtacgctcgagatctactgcaatgcctagggagtgctcttcttcaagtccgacgcgcccgatgcctctgtctatgactacggtgacttcgcgcccatcatggagcgtcagcgtctcatcgcgaccgtcgattacaccgactacatctcgggcttctcgctactcgtgctccacgtgacttgattcacatgtcgaggcgtctccccttggagtacgcatgcagcaccatgcagctg

SEQ ID NO: 36527 - protein, 92 aa, Zea mays
  misc_feature: Ceres CLONE 1420415-F
  misc_feature: SWISSPROT Homolog: EC 2.3.1.144 Anthranilate N-benzoyltransferase
MAITVRRSTMVRPVRETPRQRVWNSNLDLVVPRFHTPSVYFYRRDGPVPDAEGFFDGQRMRRALADALLPFYPMPGRLSRDEDGTLEIYCNA

SEQ ID NO: 36528 - DNA, 653 bp, Zea mays
  misc_feature: Ceres CLONE 1420422-F
  misc_feature: Encodes the peptide sequence at SEQ ID NO. 36529
  misc_feature (523)..(523): n is a, c, t, g, unknown, or other
  misc_feature (560)..(560): n is a, c, t, g, unknown, or other
  misc_feature (601)..(601): n is a, c, t, g, unknown, or other
ggagctccccgcggtggcggccgctctagaactagtggatcccccgggctgcaggaattcgcacgagaccattacctagaacatcctaatcgaaaaaacaaccatttcttcttcctttttctatatcgcgttacgtccctacccagcgatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttgggtgagggctctgctggtcaggtcacaaggaacatgcttgcaaatgagggtgtccgttctttctacaagggtttgtcccgcggattgctgangcaagcgacgtacacgactgctcgtcttggatccttnaggggtctaactacaaaagcagtgaaaaggatgaagggaangcattgcctctatttcagaaaagcttttatggtctgactgctggtgcaattg

SEQ ID NO: 36529 - protein, 126 aa, Zea mays
  misc_feature: Ceres CLONE 1420422-F
  misc_feature (27)..(116): Pfam Name: Mito_carr Pfam Description: Mitochondrial carrier protein
  misc_feature (89)..(89): Xaa is any aa, unknown, or other
  misc_feature (101)..(101): Xaa is any aa, unknown, or other
  misc_feature (115)..(115): Xaa is any aa, unknown, or other
MADAKQQQQQQQQQPQQAAAAATGVWKTVKPFVNGGASGMLATCVIQPIDMVKVRIQLGEGSAGQVTRNMLANEGVRSFYKGLSRGLLXQATYTTARLGSXRGLTTKAVKRMKGXHCLYFRKAFMV

SEQ ID NO: 36530 - DNA, 716 bp, Zea mays
  misc_feature: Ceres CLONE 1420431-F
  misc_feature: Encodes the peptide sequence at SEQ ID NO. 36531
ctccccgcggtggcggccgctctagaactagtggatcccccgggctgcaggaattcgcacgagaccattacctagaacatcctaatcgaaaaactcatcaacccacactccagcacacagcaatggcgttcacgcggcgtcatccgtgcggcatcctcctcctctccctgctggcggcatccggctcgctgtcgctggccgccaccggcccgggcgacgtggccgtcttctggggccggaacaaggacgagggcacgctgcgcgaggcctgcgacacgggcacctacaccaccgtcatcatctccttcctccgcggcttcggccacggcgccgcctactactcgctcgacctctcgggccacccgctcgcgggcgtcggcgccgacgtcaagcactgccaggccaagggcatcctcgtgctcctctccatcggcgggccgcccaacaccaacaccggcgccggcgccggctactccctcccgtccgcgcgggcggcggcggacctcgccgcgtacctgtgggacgcctacctgggcggctcgcgcgcggggctgcgccgcccgttcggcgacccggcgctggacggcgtccacctgtacatcgaccagggcggcgtcaacggcactaaaacgagctggccaggcgcctctacgcctacaaaagaactaccgcggcaagctccgggtgaccctgaacgccacggagcgagtgcccta

SEQ ID NO: 36531 - protein, 198 aa, Zea mays
  misc_feature: Ceres CLONE 1420431-F
  misc_feature (31)..(189): Pfam Name: Glyco_hydro_18 Pfam Description: Glycosyl hydrolases family 18
  misc_feature: SWISSPROT Homolog: EC 3.2.1.14 Chitinase
MAFTRRHPCGILLLSLLAASGSLSLAATGPGDVAVFWGRNKDEGTLREACDTGTYTTVIISFLRGFGHGAAYYSLDLSGHPLAGVGADVKHCQAKGILVLLSIGGPPNTNTGAGAGYSLPSARAAADLAAYLWDAYLGGSRAGLRRPFGDPALDGVHLYIDQGGVNGTKTSWPGASTPTKELPRQAPGDPERHGASAL

SEQ ID NO: 36532 - DNA, 697 bp, Zea mays
  misc_feature: Ceres CLONE 1420445-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (431)..(431): n is a, c, t, g, unknown, or other
  misc_feature (469)..(469): n is a, c, t, g, unknown, or other
  misc_feature (484)..(484): n is a, c, t, g, unknown, or other
  misc_feature (491)..(491): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctggggctccaccgcggtggcggccgctctagaactagtggatcccccgggctgcaggaattcgcacgagaccattacctagaacatcctaatcgaaaaatcgacccagccatctcctcaccctcgttcaccacacagtccggccactcctttagtagcttgtgatttgtacgtcgacgagatcactggtcgggtggcggacgacgacacatggggaaaggtagtgtnggtgcatcatggtgggggcgtcctcctgctcgcccggncgtgctgctgggtcntaacaanccacggcccggggcggaaagacggaattggtccaacggggaaccccaaaggagggccctggccgtggggtggaaaacaaggccttggcaagttggggcatttacggaaaaaggccccccccccccgaaaaaaagggaaattccaaaaaacccgagtgcccccccaagggggggccccccactaaatttttaaacccggggggaaaa

SEQ ID NO: 36533 - DNA, 652 bp, Zea mays
  misc_feature: Ceres CLONE 1420446-F
  misc_feature: Encodes the peptide sequence at SEQ ID NO. 36534
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (441)..(441): n is a, c, t, g, unknown, or other
  misc_feature (444)..(444): n is a, c, t, g, unknown, or other
  misc_feature (450)..(450): n is a, c, t, g, unknown, or other
  misc_feature (451)..(451): n is a, c, t, g, unknown, or other
  misc_feature (566)..(566): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaactgggactccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattccctgccggcggcggcgcccggatcaggtcccacggcgcngcngctgcnncgggcgggaccgactatgggacggacgacagcaagatctcccccgacgagatccctctcgagggctgcgactacaaccactggctcatcaacatgggacttccccggacccaaanccgtcccggcgaaaaaatgatccagaacataccttccagactcttccccaaaggccttccgggaattatttaagaagcccaaaaaa

SEQ ID NO: 36534 - protein, 128 aa, Zea mays
  misc_feature: Ceres CLONE 1420446-F
  misc_feature (67)..(67): Xaa is any aa, unknown, or other
  misc_feature (105)..(105): Xaa is any aa, unknown, or other
MALALRLRRVLAAASTAAPLLRPSTSVARPCPLVPLASPVAPLPLPPWRFPAGGGARIRSHGAAAAXGGTDYGTDDSKISPDEIPLEGCDYNHWLINMGLPRTQXRPGEKMIQNIPSRLFPKGLPGII

SEQ ID NO: 36535 - DNA, 814 bp, Zea mays
  misc_feature: Ceres CLONE 1420447-F
  misc_feature: Encodes the peptide sequence at SEQ ID NO. 36536
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (242)..(242): n is a, c, t, g, unknown, or other
  misc_feature (475)..(475): n is a, c, t, g, unknown, or other
  misc_feature (506)..(506): n is a, c, t, g, unknown, or other
  misc_feature (553)..(553): n is a, c, t, g, unknown, or other
  misc_feature (567)..(567): n is a, c, t, g, unknown, or other
  misc_feature (572)..(572): n is a, c, t, g, unknown, or other
  misc_feature (573)..(573): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactggaactccaccgncggtggcggccgctctagaactagtggatcccccgggctgcaggaattcgcacgagaccattacctagaacatcctaatcgaaaaaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggncgtgtccgtccctggtgtgggcgcgacggcngtgtgcaacatgagcaacgagcagttcatgtcgtggcagccccgcgncgccaagaagaacngaccnngcggcccgcgcccgtcccagggcgtgctgccaaccccctggccgggggcgaaccttcaagggccttgttgccggctcaaaaaatctgcccggggaagtgggggtttaaaaaattgaacccccaaggcggcccatgggaaccttccggcccaaagtgtggggccttcccacccgccccccaattgggtataaaagtggggtttttccccaaagccaaacccaaaagggggaaagggcccccc

SEQ ID NO: 36536 - protein, 99 aa, Zea mays
  misc_feature: Ceres CLONE 1420447-F
  misc_feature (29)..(29): Xaa is any aa, unknown, or other
  misc_feature (55)..(55): Xaa is any aa, unknown, or other
  misc_feature (60)..(60): Xaa is any aa, unknown, or other
  misc_feature (62)..(62): Xaa is any aa, unknown, or other
MAATSSKSSSSSSSAQRAAAALLVAAAVXVSVPGVGATAVCNMSNEQFMSWQPRXAKKNXPXGPRPSQGVLPTPWPGANLQGPCCRLKKSARGSGGLKN

SEQ ID NO: 36537 - DNA, 602 bp, Zea mays
  misc_feature: Ceres CLONE 1420453-F
  misc_feature: Encodes the peptide sequence at SEQ ID NO. 36538
  misc_feature (531)..(531): n is a, c, t, g, unknown, or other
aaactggagctccccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagaaagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaacaactacccccggcgtggccggcaaacggcgcgacgttctactttcctggtgttcgccatcctggccccgncttggtggggccgcggccgtccaagcttggcgggcgttgcaacaaccgtgcgcgccctggcgcccacgaca

SEQ ID NO: 36538 - protein, 86 aa, Zea mays
  misc_feature: Ceres CLONE 1420453-F
  misc_feature (63)..(63): Xaa is any aa, unknown, or other
MAGIGRNMVAPLLVLNLIMYIIVIGFASWNLNHFINGQNNYPRRGRQTARRSTFLVFAILAPXWWGRGRPSLAGVATTVRALAPTT

SEQ ID NO: 36539 - DNA, 663 bp, Zea mays
  misc_feature: Ceres CLONE 1420455-F
  misc_feature: Encodes the peptide sequence at SEQ ID NO. 36540
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaaaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttaacatagtgcaggagtatgtcaagtcgcactagatgtaacacgtttcagtaatactctacatttggatctgggcttaatattatgctt

SEQ ID NO: 36540 - protein, 140 aa, Zea mays; identical to SEQ ID NO: 4593
  misc_feature: Ceres CLONE 1420455-F
  misc_feature (25)..(120): Pfam Name: Ribosomal_L7Ae Pfam Description: Ribosomal protein L7Ae/L30e/S12e/Gadd45 family

SEQ ID NO: 36541 - DNA, 633 bp, Zea mays
  misc_feature: Ceres CLONE 1420459-F
  misc_feature: Encodes the peptide sequence at SEQ ID NO. 36542
  misc_feature (209)..(209): n is a, c, t, g, unknown, or other
  misc_feature (214)..(214): n is a, c, t, g, unknown, or other
  misc_feature (216)..(216): n is a, c, t, g, unknown, or other
  misc_feature (217)..(217): n is a, c, t, g, unknown, or other
  misc_feature (223)..(223): n is a, c, t, g, unknown, or other
  misc_feature (224)..(224): n is a, c, t, g, unknown, or other
  misc_feature (237)..(237): n is a, c, t, g, unknown, or other
  misc_feature (259)..(259): n is a, c, t, g, unknown, or other
aaagctggagctccccgcggtggcggccgctctagaactagtggatcccccgggctgcaggaattcgcacgagaccattacctagaacatcctaatcgaaaacactgaactgaacacgcgcgcgcgcacgccatccgccctccgtagcgtgcggcgtgccgtcaatccaaacccacaaaagcgatgccgccccgcgtcgcaaaacgggncacgncnngcgcgnncgcgggaaggacnaactgtcccccgcggaagccangcttggcaatattgaaactcgcaaaacatgtgttcggtgccaatgggcttgcggccctgatcccgtggggcttgccgccccccggttgggggggggggcccaaccggccccttttgaggggaactcctttccccccgggaacccgaacacctcctcctttaaggggtggtccccccggttggggtccccccggtttttttccaaatctccccaggtccgcccccccccccgggggggggtgatttttcctccccccccggggggggccgccccctggtggggggggggcccccccgggggggtgcctataccaactaaaatgttggtggaccccaccacaaaaaacttgttggggggcgggggccccccccccc

SEQ ID NO: 36542 - protein, 105 aa, Zea mays
  misc_feature: Ceres CLONE 1420459-F
  misc_feature (9)..(9): Xaa is any aa, unknown, or other
  misc_feature (11)..(11): Xaa is any aa, unknown, or other
  misc_feature (12)..(12): Xaa is any aa, unknown, or other
  misc_feature (14)..(14): Xaa is any aa, unknown, or other
  misc_feature (26)..(26): Xaa is any aa, unknown, or other
MPPRVAKRXTXXAXAGRTNCPPRKPXLAILKLAKHVFGANGLAALIPWGLPPPGWGGGPNRPLLRGTPFPPGTRTPPPLRGGPPGWGPPGFFPNLPRSAPPPGGG

SEQ ID NO: 36543 - DNA, 658 bp, Zea mays
  misc_feature: Ceres CLONE 1420461-F
  misc_feature: Encodes the peptide sequence at SEQ ID NO. 36544
aaagctggagctccccgcggtggcggccgctctagaactagtggatcccccgggctgcaggaattcgcacgagaccattacctagaacatcctaatcgaaaaacgttgttcctcccgaccctcgccgtccctcccgccgcgacccgccctcctcctcccgaccacgccgcccagcccgtggaccactccctcccagcctcgccctcccacggcgtccctcccgccgtgacccttcctcctcctcccgacctcgccgcctagcccgtgtcgccgccgtcgcccgtgccactctgctgctgcgaccacgacaatggggatgtggaatttggtgtgcgtcaccgacgcatcagcgtacatcgcgtcctggatcgtcaggctcctcctcgaccgtggctacaccgtccgcgccaccgtgcgagacacagcctttggaaatgtagagcccacctcagctgatctattcaagaacttccattatagcagaaacaatggatttaccgagtttgtacagaaagcaattgatgatatggaaagcatcatgagtgaaccaatacaagatggacatgaaccacagttagcacatgaagttgtttctcaggttgtcaaaatcaactacttttcttcgcgttgcaggtgtttgttcggactccaagagtac

SEQ ID NO: 36544 - protein, 116 aa, Zea mays
  misc_feature: Ceres CLONE 1420461-F
  misc_feature: SWISSPROT Homolog: EC 1.1.1.219 Dihydrokaempferol 4-reductase
MGMWNLVCVTDASAYIASWIVRLLLDRGYTVRATVRDTAFGNVEPTSADLFKNFHYSRNNGFTEFVQKAIDDMESIMSEPIQDGHEPQLAHEVVSQVVKINYFSSRCRCLFGLQEY

SEQ ID NO: 36545 - DNA, 648 bp, Zea mays
  misc_feature: Ceres CLONE 1420462-F
  misc_feature (215)..(215): n is a, c, t, g, unknown, or other
  misc_feature (220)..(220): n is a, c, t, g, unknown, or other
  misc_feature (235)..(235): n is a, c, t, g, unknown, or other
  misc_feature (236)..(236): n is a, c, t, g, unknown, or other
  misc_feature (258)..(258): n is a, c, t, g, unknown, or other
  misc_feature (259)..(259): n is a, c, t, g, unknown, or other
  misc_feature (261)..(261): n is a, c, t, g, unknown, or other
  misc_feature (262)..(262): n is a, c, t, g, unknown, or other
  misc_feature (265)..(265): n is a, c, t, g, unknown, or other
  misc_feature (268)..(268): n is a, c, t, g, unknown, or other
  misc_feature (269)..(269): n is a, c, t, g, unknown, or other
  misc_feature (274)..(274): n is a, c, t, g, unknown, or other
  misc_feature (275)..(275): n is a, c, t, g, unknown, or other
  misc_feature (277)..(277): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (287)..(287): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (294)..(294): n is a, c, t, g, unknown, or other
  misc_feature (295)..(295): n is a, c, t, g, unknown, or other
  misc_feature (299)..(299): n is a, c, t, g, unknown, or other
  misc_feature (303)..(303): n is a, c, t, g, unknown, or other
  misc_feature (304)..(304): n is a, c, t, g, unknown, or other
  misc_feature (329)..(329): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (350)..(350): n is a, c, t, g, unknown, or other
  misc_feature (368)..(368): n is a, c, t, g, unknown, or other
  misc_feature (369)..(369): n is a, c, t, g, unknown, or other
  misc_feature (375)..(375): n is a, c, t, g, unknown, or other
  misc_feature (378)..(378): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (390)..(390): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (408)..(408): n is a, c, t, g, unknown, or other
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (433)..(433): n is a, c, t, g, unknown, or other
  misc_feature (434)..(434): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (482)..(482): n is a, c, t, g, unknown, or other
  misc_feature (484)..(484): n is a, c, t, g, unknown, or other
  misc_feature (485)..(485): n is a, c, t, g, unknown, or other
  misc_feature (508)..(508): n is a, c, t, g, unknown, or other
  misc_feature (606)..(606): n is a, c, t, g, unknown, or other
  misc_feature (628)..(628): n is a, c, t, g, unknown, or other
gccggaagtcgcacgagaccattacctagaacatcctaatcgaaaaagcaaacccctctcgattttcacacccagccgcgacccatcgcgacctgacccgaccctcccgaggccgccagccttatcctctccgcctcctgatcccgccgtcccctccgacccagcacaggcgcgagtagaagacatgggctcgacgttcggtgccacttctaccnttggncttatggttgctccnncggggaagaatgtgcgccttcnnannagnctnncttcnnantataannngntnnnganntgtntttnntctggggtggggtggtgggtgtgtngaagnnnnnnacnnnnnntcngtgggcttggtgggtggnncggggnttnccctcnnnnccnannnnannngnnngnngnntnnnnnnnnnnnntnnnntttttnncnnnnnnnnnnannnnnnnnnnnnnnnnnnnnnnnnnnnnnnnaaggntnnaggcacccccccccccccactgntcgctgttgtaggtcgaggtaagcttccccctaaggaagagaagaaaggagctgggagtatgtgacaatcctctgtctgtcgctccccgcggcagggngcggatttgcgcgaccgccgtncctagcctaaacaatcttat

SEQ ID NO: 36546 - DNA, 639 bp, Zea mays
  misc_feature: Ceres CLONE 1420463-F
  misc_feature: Encodes the peptide sequence at SEQ ID NO. 36547
aagctggagctccccgcggtggcggccgctctagaactagtggatcccccgggctgcaggaattcgcacgagaccattacctagaacatcctaatcgaaaactaatcgaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcataaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtactcctttctgttcgatgcaaggacaacaatgctgcacatgccagtgaagctctgcgacgcgccaagttcaag

SEQ ID NO: 36547 - protein, 158 aa, Zea mays
  misc_feature: Ceres CLONE 1420463-F
  misc_feature (5)..(158): Pfam Name: Ribosomal_L16 Pfam Description: Ribosomal protein L16
MGRRPARCYRQIKNKPYPKSRYCRGVPDPKIRIYDVGIKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFK

SEQ ID NO: 36548 - DNA, 664 bp, Zea mays
  misc_feature: Ceres CLONE 1420470-F
  misc_feature: Encodes the peptide sequence at SEQ ID NO. 36549
aaagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgcctgccgcggtgtgggcgggcggcgtctacgagaccatgtgagcggccgatctccttccgccgggccacccggacccgtccgtcctggaggggctgctccgcctgctggcgttccacggcgttttctacgagtgaagggagtccacacccacatgggagtgacggctatacgaacttaccgccctgggccaggatccggtgcctgggttcgtcctaggcgcgtgtctatctctgctaagaagggctaccccaaccagatgtcttggggcgagatcggcaacagctgcatcaagccatgcttcatgacggccaagcggaatcccctccatg

SEQ ID NO: 36549 - protein, 63 aa, Zea mays
  misc_feature: Ceres CLONE 1420470-F
MPPPSANGATAAAAAARDDMSPAEARLAMMELANMVSVPMALAAVIRLGVPAAVWAGGVYETM

SEQ ID NO: 36550 - DNA, 640 bp, Zea mays
  misc_feature: Ceres CLONE 1420474-F
  misc_feature: Encodes the peptide sequence at SEQ ID NO. 36551
  misc_feature (640)..(640): n is a, c, t, g, unknown, or other
ttcccccgggctgcgggaattcccccgagaccattacctagaacatcctaatcgaaaaacccaggaacaagcaacctcgtccccaaaaaagcaaccaccgcctccccgatttcgtcgggaggaagccccatcccgaaaccgccgccgttattccaatggggcccaaggccgaaaaaaagcccgccgccaaaaaacctgcggaggaggagccggcggcggaaaaggccccggcggggaaaaagcccaagggcgagaagggggtccctgcgggcaattccccgggcaaggggggggggggagaaaaaggggaaaaaaaaagcgaaaaattcggggggaacctccaaagatctacatcttcaagggggctgaagcagggggccccgggatattggtttttcttccaaggcccgtggccctcatgaactccttcttcaaagacatcttcttataaacttgggggggaggggggccaactggcgcggttccacaagaaggctaccctttcgtcccggggagatccagaacttcgttgcgccttgttctccccgggagaggtggccaaggacgccgttctccgaggggggcccaaacccctcccccagttttcttagctcctgggggagcgagtgggacgtgcacn

SEQ ID NO: 36551 - protein, 88 aa, Zea mays
  misc_feature: Ceres CLONE 1420474-F
MGPKAEKKPAAKKPAEEEPAAEKAPAGKKPKGEKGVPAGNSPGKGGGGEKGEKKSEKFGGNLQRSTSSRGLKQGAPGYWFFFQGPWPS

SEQ ID NO: 36552 - DNA, 678 bp, Zea mays
  misc_feature: Ceres CLONE 1420491-F
  misc_feature: Translation starting site: 351
aagctggagctccccgcggtggcggccgctctagaactagtggatcccccgggctgcaggaattcgcacgagaccattacctagaacatcctaatcaaaaaatttaggtcttacgacccgcccaaagctcacgccggacctgctcctctccgacggcggcatcggcttcgtgctccgctactttcccaaggcgttcaagccccgcccccgcccaggccacgaggtggacgacctccccaacctcatcaagctctacgcggactggcactcccgcctgatcccgtactactccttcgaacagttcgtgcgcaaactccagaaattgggtgccggcaaccgcgtcagggacgatggtgggcctctctgaaggggagaaacacttcatccgcggcggcattgcacaagatcttcacaccccacgacctaggcggctgcagttccggtccctctccgtccaaaccggagccattccacaggcgaacggctcaccgcgtgttacgttgggggccactgatataatcgctactgccacggctgcactaggaaaaccaagcattctcccccctgaaaaagggaaaagtggccattttttgccgactggtagcccaacccgctgagcccactgtcttgagggtacaaggattcagaaaaaattgcccttgctaaccctctccggtt

SEQ ID NO: 36553 - DNA, 647 bp, Zea mays
  misc_feature: Ceres CLONE 1420492-F
  misc_feature: Encodes the peptide sequence at SEQ ID NO. 36554
  misc_feature (310)..(310): n is a, c, t, g, unknown, or other
  misc_feature (404)..(404): n is a, c, t, g, unknown, or other
ctggagctccccgcggtggcggccgctctagaactagtggatcccccgggctgcaggaattcgcacgagaccattacctagaacatcctaatcgaaaaattcgcagcgtgtctcttcctccatcgcagcgtgtctcgtgctccccccaggctcctcttcctcgctttccctccaccccgggagcaaaccctaaccctaccgtctctcgccccgcggcgtctgccaatggcgcgccccgtgtgagtgtgcgcgagagaggggtagaccttgaggccgctacccggggaggagagcgagagatgtataaacntgggggagcggggggaggggctgggctggaccggaagcggatcaacgacgcgctggataagcatctcgagaaggcggtcgcgtcgccgtccacntcgagggggtcagcgggcggcgggatcgaccaccaccgcctcgtcgtgccgtcctccgtgtcgtccatccccaagggccgctgctccgaaggggagtctgattctgatagtgaagcatcagatgttagcggctctgatggacaacacacctcatggatatcatggtattgcaacttaagagggaatgagttcttctgtgaagtcgacgatgattatattcaagacgacttcaacctttgtggt

SEQ ID NO: 36554 - protein, 116 aa, Zea mays
  misc_feature: Ceres CLONE 1420492-F
  misc_feature (4)..(4): Xaa is any aa, unknown, or other
MYKXGGAGGGAGLDRKRINDALDKHLEKAVASPSTSRGSAGGGIDHHRLVVPSSVSSIPKGRCSEGESDSDSEASDVSGSDGQHTSWISWYCNLRGNEFFCEVDDDYIQDDFNLCG

SEQ ID NO: 36555 - DNA, 578 bp, Zea mays
  misc_feature: Ceres CLONE 1420494-F
  misc_feature: Encodes the peptide sequence at SEQ ID NO. 36556
  misc_feature (381)..(381): n is a, c, t, g, unknown, or other
  misc_feature (382)..(382): n is a, c, t, g, unknown, or other
  misc_feature (539)..(539): n is a, c, t, g, unknown, or other
aaagctggagtccccgcggtggcggccgctctgaatagtggatcccccgggctgcagattcgcacgagaccattacctagaacatcctaatcgaaaagacaggtaatggcttccgccgcggtgctccggaacgccggatctcgccgcctcttctcctaccccaccctccgtgctgctgcaatctcgggacccgccgtgctaccagatgcgcccgtggcggcgtcggtggcggcccagccgcccccgctggcctggaactctgggcaatgtcatggccaccttcaacgcacgaagcccatgtgacgtcggcacccttggcacgtcgatacggcaaaacagtctcactgccgctattaccagggaatatcactacaggaattnngctgcgatgatgctatgtgcctatctcctctcctttgactcctcactaagtgacggtgaagaaactgacaaaaaggggctgtggtaaacgccctaaggtccagccctaaaaagatttcaaaccgagtcccagaaagggaatccagtacccaaccttnttcaagggatgccggtaaaaaatgccctacggcacctgc

SEQ ID NO: 36556 - protein, 65 aa, Zea mays
  misc_feature: Ceres CLONE 1420494-F
MASAAVLRNAGSRRLFSYPTLRAAAISGPAVLPDAPVAASVAAQPPPLAWNSGQCHGHLQRTKPM

SEQ ID NO: 36557 - DNA, 756 bp, Zea mays
  misc_feature: Ceres CLONE 1420496-F
  misc_feature: Encodes the peptide sequence at SEQ ID NO. 36558
  misc_feature (23)..(23): n is a, c, t, g, unknown, or other
  misc_feature (25)..(25): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
ttgggttgtgggccccccccccntntccccgcgttcccanccaaannttntnnnnaaaaactgggactccccgcggtggcggccgctctagaactagtggatcccccgggctgcaggaattcgcacgagaccattacctagaacatcctaatcgaaaaagttgttcctcccgaccctcgccgtccctcccgccgcgacccggcctcctcctcccgaccacaccgcccagcccgtgtaccactccctcccagcctcgccctcccacgccgtccctcccgccgtgacccttcctcctcctcgggaggtcgccgcctagcccgtgtcgccgccgtcgccggtgccactctggtgctgcgaccacgacaatggggatgtggaagtgggtgggcgtcaccgaggcggggggggacgtcggggccgggatggtcagggtagtgttgaaccatgcctaccccggccgggggggcggggggaggagtaaaacctttacaaatccacacccccacctccagttgatcgatctccggaaccttccattatggccagaaacaatggcatttaccccgagttcggtcccggaacccaatttgatggatatgggaaggggcatccgttgggtggaacccccttaccaagaaggggagcatgaaacccaaaatctttacgcgaaccgaaaggttgtttgtccggaagggtgtggtcaaaaaggcccagctacctttttccccttcccggaattgcccacggtggggttcg

SEQ ID NO: 36558 - protein, 130 aa, Zea mays
  misc_feature: Ceres CLONE 1420496-F
MGMWKWVGVTEAGGDVGAGMVRVVLNHAYPGRGGGGRSKTFTNPHPHLQLIDLRNLPLWPETMAFTPSSVPEPNLMDMGRGIRWVEPPYQEGEHETQNLYANRKVVCPEGCGQKGPATFFPFPELPTVGF

SEQ ID NO: 36559 - DNA, 648 bp, Zea mays
  misc_feature: Ceres CLONE 1420506-F
  misc_feature: SWISSPROT Homolog: EC 3.2.1.15 Polygalacturonase
  misc_feature (503)..(503): n is a, c, t, g, unknown, or other
agtggatcccccgggctgcaggaattcgcacgagaccattacctagaacatcctaatcgaaaaagaggagggttggcttctcctccccctccggttcgggttcggggtcttgcaggttctccggggttcagtaacaagtgtaatcccatctaactggcagcaactcatgtaatagggcggacattttggaagatgcctcttatgggtcagggactagcctcgtttaacaacgcctgctaaacataccgcaaggactgctcctccaagatcagatttcatcggcatattgataaaaccattcgatgaggcatgcgagtttctctacccggaggaggggattggtaactccaggtgaagacataaattcggaggatgatggatgcccccaacatgaaacgctcccaggaggattactcttccaggcactgtaaaaggtgacggaaacggtaacgggaatgaccactggaggcgctttccccacgattaatgggtttaagttgaanggaggggggatctttgacggggaaggaaacgctgcgtggaggggcaataattgccacaaaattgggtttaatcccttgcaaggaaacccccgtctcagccatccggttcgctcttccgcgaccgacccctcaaataaacacgcct

SEQ ID NO: 36560 - DNA, 625 bp, Zea mays
  misc_feature: Ceres CLONE 1420511-F
  misc_feature: Encodes the peptide sequence at SEQ ID NO. 36561
  misc_feature (197)..(197): n is a, c, t, g, unknown, or other
  misc_feature (231)..(231): n is a, c, t, g, unknown, or other
  misc_feature (233)..(233): n is a, c, t, g, unknown, or other
  misc_feature (240)..(240): n is a, c, t, g, unknown, or other
  misc_feature (249)..(249): n is a, c, t, g, unknown, or other
  misc_feature (274)..(274): n is a, c, t, g, unknown, or other
aaagctggagctccccgcggtggcggccgctctagaactagtggatcccccgggctgcaggaattcgcacgagaccattacctagaacatcctaatcgaaattttcgttcccctttccgccgtgcctcccactaaaccctagatctctctctctagaatgccgacgccttcggctctcagcaagcgcgggcgcgacngcggggacggcatcctggccgccctctccgttcnancagtgcngcccacggncaaaaggcgcggccgtggcaaaaanctgctgccgaacacggggaaggcggcgtggatcccgggaacaaacttcctggggctgggggggcccctgatcaccaaattgcaccgggaaaaaaaattcaacgacctcagagttgaaaaacaaaacctttttgggcgggggcccccccccccccccccaaaccaaaaaaaaaaaccggggataaaaacctttttttccccccccccttttcctttttcaagggtttttgtttaataacaagtctccctttcggtttcctatcaagttcctctttctgggtttttaacaagtttcccttttctcccccctttttgggccaaaggggtttccccccccccacctttgttggtg

SEQ ID NO: 36561 - protein, 116 aa, Zea mays
  misc_feature: Ceres CLONE 1420511-F
  misc_feature (14)..(14): Xaa is any aa, unknown, or other
  misc_feature (25)..(25): Xaa is any aa, unknown, or other
  misc_feature (26)..(26): Xaa is any aa, unknown, or other
  misc_feature (28)..(28): Xaa is any aa, unknown, or other
  misc_feature (31)..(31): Xaa is any aa, unknown, or other
  misc_feature (39)..(39): Xaa is any aa, unknown, or other
MPTPSALSKRGRDXGDGILAALSVXXVXPTXKRRGRGKXLLPNTGKAAWIPGTNFLGLGGPLITKLHREKKFNDLRVEKQNLFGRGPPPPPPNQKKKPGIKTFFSPPPFPFSRVFV

SEQ ID NO: 36562 - DNA, 710 bp, Zea mays
  misc_feature: Ceres CLONE 1420521-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (126)..(126): n is a, c, t, g, unknown, or other
  misc_feature (127)..(127): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (187)..(187): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (288)..(288): n is a, c, t, g, unknown, or other
  misc_feature (299)..(299): n is a, c, t, g, unknown, or other
  misc_feature (303)..(303): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnngnngggnnnnnnnnnnnnnnnnnnnnnnnnnnnnnnnnnnnnnnnnnnnnnnnngnnnnnngngnnnnnnnnnnnnnnnnnnnnnnnnnnnnnnnnnnnnnnnnnnnnnnnnnnnnnnnnnnnnnnnnnnnnnnnnttttttttnnnnnnnnnccaaaactggngactccaccgncggntggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagccttacaatgccttgatccaccaccgggggtgccacgggaaagttggcgggggttacggggaacctccaggcccgggggcgggcatgcaccggcaaagggcccaacccccccccaaaaaccccggggcccccttattttaacggcccctctaaagggccccaaaaggggccccgaaaaactttttggggggggggccaaaacccggggggggtttcccccgggggttttttttcctgggc

SEQ ID NO: 36563 - DNA, 677 bp, Zea mays
  misc_feature: Ceres CLONE 1420523-F
  misc_feature: Encodes the peptide sequence at SEQ ID NO. 36564
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaaagataagatcgagcagcgagagacgggcaggggagaggaaaaaaaaatctaaccctagcatccgcagcgctagggttcgggggttgcgatggcggcggcggcgaggcagcgggggacggtgaagtggttcaacaacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggctacggctcccgcggcggtggcggatctggcggcggcggtcgcagctacagtggtagctggggcggcggccggagatccggcggcgggggcggtcccggcgcgtgctacaagtgcggcgagcccggccacatggccagggactgccctagcgccgacggcggaggctacggcggatgcggctacgggcggttttgccctacggaggaggaggaggcan

SEQ ID NO: 36564 - protein, 162 aa, Zea mays
  misc_feature: Ceres CLONE 1420523-F
  misc_feature (6)..(73): Pfam Name: CSD Pfam Description: 'Cold-shock' DNA-binding domain
  misc_feature (123)..(140): Pfam Name: zf-CCHC Pfam Description: Zinc knuckle
MAAAARQRGTVKWFNNTKGFGFISPEDGSEDLFVHQSSIKSEGFRSLAEGEEVEFSVSEGDDGRTKAVDVTGPDGSFVRGGGGGGGGGGGYGSRGGGGSGGGGRSYSGSWGGGRRSGGGGGPGACYKCGEPGHMARDCPSADGGGYGGCGYGRFCPTEEEEA

SEQ ID NO: 36565 - DNA, 663 bp, Zea mays
  misc_feature: Ceres CLONE 1420529-F
  misc_feature: Encodes the peptide sequence at SEQ ID NO. 36566
acaagctggagctccccgcggtggcggccgctctagaactagtggatcccccgggctgcaggaattcgcacgagaccattacctagaacatcctaatcgaaaaattcggtttccggatagcttacctcacatcgacggtcggtgagccgttcgtgagtggcgaggcagtgcgtgcgctgcaacctgcagggcaagaacaggcgacgaagaatatgagcacgctggacacgcggacgctcaaggacgagctgactagcatggacaggaagtgcctcgtggaccttggccacccgctgctcaaccgcgtcgccgacagcttcatccgcgccgccggggtcggggcggccagggccgtctccagggaggcctacatcgtcaccgtcgaagggctttcaagagactcgtccgggatggacgccgacggcggctagcggagccatttctccaacatcggaggtgacgacggccagaggtcgctcgacgcaatggtaaaaacggccggcaaggaggccttccagtgggggttggcagccggagtctactctgggctcacgtacgcgctgcgggaggccaggggatgccacgactggaagaacagcgccatcacaagcgccatcgctggggcggcggtagcgctcacgggtgacaccggcggccactccg

SEQ ID NO: 36566 - protein, 72 aa, Zea mays
  misc_feature: Ceres CLONE 1420529-F
MSTLDTRTLKDELTSMDRKCLVDLGHPLLNRVADSFIRAAGVGAARAVSREAYIVTVEGLSRDSSGMDADGG

SEQ ID NO: 36567 - DNA, 673 bp, Zea mays
  misc_feature: Ceres CLONE 1420534-F
  misc_feature: Translation starting site: 195
aaagctggagctccccgcggtggcggccgctctagaactagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggtgaacgcctcgtcagtcgacgcttcgtcgcccgcgcggcagccgtccacgccgcccccgccgcctcggcgccggcgccagcgcgcgcgacgccgcgctcaccgcctccgtgccatgaacacgggcgcacgagcggaggaggaggagggactcgtggaggccgacccggacgctgacgacgtctggcgcagggctgcaccaccagcgggagcgggaggcgtgtctgcggcgggcgtcaaggcccgtggtggtggtcgcccgagaggaggggtcccctccggacgcctccgccggctcgggtgagagcgaccgggtggggagggcgcgaactctgaccgaccaccacctgcaggagctcaaggggcgcgtggatctggggttcggcttcagataccgcgagatccccgagctgtgcggcacgctgccggtcctcgacc

SEQ ID NO: 36568 - DNA, 632 bp, Zea mays
  misc_feature: Ceres CLONE 1420538-F
  misc_feature: Encodes the peptide sequence at SEQ ID NO. 36569
  misc_feature (616)..(616): n is a, c, t, g, unknown, or other
  misc_feature (623)..(623): n is a, c, t, g, unknown, or other
caaagctggagctcaccgcggtggcggccgctctagaactagtggatcccccgggctgcaggaattcgcacgagaccattacctagaacatcctaatcgaaaaaacacgtgacaccccgcgcgcgcgcctccgccgcacgcccccactctctcaccgccaccgccgagatggccgcctgctcccacctcgccgccgcgggtggctcttcccctgccgccgccgcagtggttcgttccccggcgcattcctcagccgccgccgccttcgcgcgcctccggtcgacgctgcgtttctcgagcgccggcctgtcggttaagggaagcagggcgactttcccgtgggtcgccgccgcggggccggccgcggcggcgccggtggccgacctggacggccgcccagccacggagaagcagcccatcattgtcatcgataactacgacagcttcacctacaacctctgccagtatatgggggagcttggattgaacttcgaagtataccgcaatgatgaactgaccatagaagatgtaaagaggaagaacccaagaggaatacttatttctccagggcctggtgaaccacaagattcagggatatcattgcagactgttcttngaattangccccaccc

SEQ ID NO: 36569 - protein, 154 aa, Zea mays
  misc_feature: Ceres CLONE 1420538-F
  misc_feature: SWISSPROT Homolog: EC 4.1.3.27 Anthranilate synthase
  misc_feature (150)..(150): Xaa is any aa, unknown, or other
  misc_feature (152)..(152): Xaa is any aa, unknown, or other
MAACSHLAAAGGSSPAAAAVVRSPAHSSAAAAFARLRSTLRFSSAGLSVKGSRATFPWVAAAGPAAAAPVADLDGRPATEKQPIIVIDNYDSFTYNLCQYMGELGLNFEVYRNDELTIEDVKRKNPRGILISPGPGEPQDSGISLQTVLXIXPH

SEQ ID NO: 36570 - DNA, 577 bp, Zea mays
  misc_feature: Ceres CLONE 1420539-F
  misc_feature: Encodes the peptide sequence at SEQ ID NO. 36571
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (492)..(492): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactggaactccaccgcggtggcggccgctctagaactagtggatcccccgggctgcaggaattcgcacgagaccattacctagaacatcctaatcgaaaaaacattagcaaggcgatagataagaggaaggaaagaacataggcagccgaagcgactgtcgcgaggcaaggccatcgtccgccatgacgctctccctctccacctctttcctccccatccccgccgccgcgaggacaccgcccgcaccctacgctccgtcgtcccctcccaggggatgcgctgctcgatgcgcaagaagggggaagacagcggcgaccgctgccctttgcgagagcagtgcggaggccacccacgaccgggaaagcaggcancagttgcggtccaggctttggcgagccgccggcaaacagcagcgcgggcgggcaggccggtggacctccaaaggtcgaaacaaag

SEQ ID NO: 36571 - protein, 60 aa, Zea mays
  misc_feature: Ceres CLONE 1420539-F
  misc_feature (33)..(33): Xaa is any aa, unknown, or other
MRCSMRKKGEDSGDRCPLREQCGGHPRPGKQAXVAVQALASRRQTAARAGRPVDLQRSKQ

SEQ ID NO: 36572 - DNA, 824 bp, Zea mays
  misc_feature: Ceres CLONE 1420543-F
  misc_feature (13)..(13): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (41)..(41): n is a, c, t, g, unknown, or other
  misc_feature (45)..(45): n is a, c, t, g, unknown, or other
  misc_feature (445)..(445): n is a, c, t, g, unknown, or other
  misc_feature (448)..(448): n is a, c, t, g, unknown, or other
ttgtgggtggggnggggggnnnnntggcttcttcgcggccngggngcgggaatattttaaaactagaagtcacgccgttggcgggcgctctagaactagtggatcccccgggctgcaggaagtcgcacgagaccattacctagaacatcctaatcgaaaatccctcccgtccagcgctccagctcccctccatcctcggccaaaaattctgcggcgagctccgatccggtccgactactaacccacgccgcataagccgcgcgacctgatcgcgcgggggtccaggagaggggaagcgcggtggtgcggttgcctgccaccgtaccgccgcaggacaaggaagaggagccggtatcccttgggcccgctgccggccggaccgatggactccgagcacgggatctggcggccgggcccccgcgaaggggttctacgcggggggganccntgcacggggaagcggcgcgggggggggtagggggaaggggtgcggcccgccccgggggggaggcgcccctgcgcctgagggggtgggggaagacactactctccggaaccctgcggctgcgccccccttggaggagtgacagcgccgttcggaaacccccttaggccccgcccccgcccccggccctggggtccgcggagggggtgtaccaaaacggatttcggttcgcaacgcgtgatgagctggccggccaacaggtgtaccctttgacgtgcgaggcgatgccggcacaccaggcgggtgtaggctgatagttctctccttttgtggctgggcgcgacgcgagggcaggagacggcctcagcggcacagagcg

SEQ ID NO: 36573 - DNA, 712 bp, Zea mays
  misc_feature: Ceres CLONE 1420551-F
  misc_feature: Encodes the peptide sequence at SEQ ID NO. 36574
aaagctggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccgtgcttgggtgcccggccgccatcgcgctggcgctcatgtcgccacgccgcccgactgctagcagtgtgctagccaagccaagccaagcaggaaggcccccggcattgctagctgtacgtgtctgtgtgtgcatctgcagcagggtgcaggcaggggcccgtacctacgggtctctttctctctctcatcttgtcaccgtacctatctagagtgtgtgtgttcgtactaaataaaagttcttgtcgtcgtcgtctgggcacgcatgtaccatgtcgtcgg

SEQ ID NO: 36574 - protein, 103 aa, Zea mays
  misc_feature: Ceres CLONE 1420551-F
  misc_feature (36)..(102): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPCLGARPPSRWRSCRHAARLLAVC

SEQ ID NO: 36575 - DNA, 741 bp, Zea mays
  misc_feature: Ceres CLONE 1420552-F
  misc_feature: Encodes the peptide sequence at SEQ ID NO. 36576
atagctggagctccccgcggtggcggccgctctagaactagtggatcccccgggctgcaggaattcgcacgagaccattacctagaacatcctaatcaaaaatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgcgccgagggcggctacgtcacgacggaggctgactacgagttcatgatgcacgagttcaacgtgcggcggtgcgcgcgcgcgtcgagccacaactggacggcgtgcccctacccatcacccgggggaggccgcgccgtcggcgggaccctcccctccggggccaacccggggaacccctgccaggactttcggggccccacccgggcgcggggaccccgttcgccccaggggggggccacctttgccccatcgcgcataggcaaccttctaaggctgggggatgcacccgcgtcccgtttacgtaaattcaccccctgaccacgcggggcaccttccttgccccccgcccccactctgtttacttaaaaagaccctccgctggtt

SEQ ID NO: 36576 - protein, 149 aa, Zea mays
  misc_feature: Ceres CLONE 1420552-F
MVSRENLHLVLDPASLGAPWADPSAAEIPPQLLAALGEYLSSTRAEGGYVTTEADYEFMMHEFNVRRCARASSHNWTACPYPSPGGGRAVGGTLPSGANPGNPCQDFRGPTRARGPRSPQGGATFAPSRIGNLLRLGDAPASRLRKFTP

SEQ ID NO: 36577 - DNA, 777 bp, Zea mays
  misc_feature: Ceres CLONE 1420553-F
  misc_feature: Encodes the peptide sequence at SEQ ID NO. 36578
  misc_feature (519)..(519): n is a, c, t, g, unknown, or other
  misc_feature (568)..(568): n is a, c, t, g, unknown, or other
atagctggagctccccgcggtggcggccgctctagaactagtggatcccccgggctgcaggaattcgcacgagaccattacctagaacatcctaatcgaaaacctttcctcgcccctacccccgccaccgccgccgccgtcgccgcagccatggcgtcgcggcgctgtctcctccgcttcctctcgatccgcctcgttcctcagagatctcaacctcttgcgccgatctcgactgcgacccggaccctaacctctttgtccgaggccctcggctccccagctccccgggccctcgcctccccccggctgtactacctcttccgctcctctgccgccgtccccgccctccggcgacgactacccggtgggtggaacacataagtgacgcggcgcagagaacctagcccgagcaagagagggacgcgagccagggacggtggggctttcttcttggctgggtgaaccacgggagtgccgggaggagcttgaatggggcggcatggctcccgcgggggtgcngccagtttcaacgagggccccccgtgggaggccgaaacaggcgcctctnactcgaggggaccttcgctcgccaacctggcgcttccccctccaactttcgacctctttcaagggctgctgcgggccgactgggcgcgacacgctccttctgcgaggtgggctcccgaacccgccgccgccgggaggagctgccggagccactcaagaacgtgatgctggagtacggcgcggcggtgacgaaactggcgcggttcgtgg

SEQ ID NO: 36578 - protein, 76 aa, Zea mays
  misc_feature: Ceres CLONE 1420553-F
MASRRCLLRFLSIRLVPQRSQPLAPISTATRTLTSLSEALGSPAPRALASPRLYYLFRSSAAVPALRRRLPGGWNT

SEQ ID NO: 36579 - DNA, 747 bp, Zea mays
  misc_feature: Ceres CLONE 1420563-F
  misc_feature: Encodes the peptide sequence at SEQ ID NO. 36580
  misc_feature (1)..(1): n is a, c, t, g, unknown, or other
  misc_feature (747)..(747): n is a, c, t, g, unknown, or other
ncaagctggagctccccgcggtggcggccgctctagaactagtggatcccccgggctgcaggaattcgcacgagaccattacctagaacatcctaatcgaaaaaattctcctttcgaatttagaatccccgtgctgagagctgagtgccgccttggttgctccgtactggactcgattcctcatcgcagcagaagcatcccgtcccctccgcttctccttgctctgctctgacaaaaaaaatagcagcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatctcaaaggatcatgagcgggcctactttgattctgctgactgggctctagggaagcaaggtgttgccaaaccaaaaggaccgctggaggcacttaggcccaagcttcagccaacacgccaacaacagcaacaacgtgcaaggcgccctatttacacttcgtcagaaaacgaggacggagacggggctggtgctgaggatatgaacatcaattgaagtggactagtggagtggaatgcctgctcagattggttgatgagcaagtcgtcactatatgtcaagtgttgtagtttgctttgcaattattggaggaattaaatgatcgtctgctgggttcatgagn

SEQ ID NO: 36580 - protein, 123 aa, Zea mays
  misc_feature: Ceres CLONE 1420563-F
  misc_feature (39)..(122): Pfam Name: Lg106 Pfam Description: Lg106-like protein
MSEVKDSNVPAALDGNPQPMDQTEDNSMPSAQQQEEAIKKKFGGLMPKKPPLISKDHERAYFDSADWALGKQGVAKPKGPLEALRPKLQPTRQQQQQRARRPIYTSSENEDGDGAGAEDMNIN

SEQ ID NO: 36581 - DNA, 702 bp, Zea mays
  misc_feature: Ceres CLONE 1420567-F
  misc_feature: Encodes the peptide sequence at SEQ ID NO. 36582
aaagctggagctccccgcggtggcggccgctctagaactagtggatcccccgggctgcaggaattcgcacgagaccattacctagaacatcctaatcgaaaactttcctttccctacggcggcggcgctggagcagctaagcagcagcaagatgttcgacggcttcaatctccgcttccgccgccagagcgccacccttggctgcgccatgactttctccatctacctgcccccgtccccggtgtccaaccttcccgtgttgtactggctctcgggtctcacctgcaccgaggataatttcatcataaagtccggcgcccagcacgccgccgctgcccacggcatcgccctcgtggcacctgacacctccccacttatcttctgcatgatggattcatttgatggaactattttaggcctctgattgcggaatacagatcgatttgcttgtcacaaggataaagcagatccacgatgagtagaagcgtgggcatccaaatgaataaccaggggagagcagtctaaggcaaatttgctaggctggagcagtcacaagagctagggactacagtcataggtcctgctagccagggtggagcagtcataagacctcctagcagtccaaggcaaaattgctaggtgggatggaaactggtgcaccactgccttgcaacctctgcactgctgcaaaacatttacctg

SEQ ID NO: 36582 - protein, 90 aa, Zea mays; identical to SEQ ID NO: 18079
  misc_feature: Ceres CLONE 1420567-F
  misc_feature: SWISSPROT Homolog: EC 3.1.2.12 S-formylglutathione hydrolase

SEQ ID NO: 36583 - DNA, 707 bp, Zea mays
  misc_feature: Ceres CLONE 1420568-F
  misc_feature: Encodes the peptide sequence at SEQ ID NO. 36584
ggccgctctagatcaaaagaggggctgggctgcaggaaaattcttaagaaagggctctagaacatcctaatcgaaaaacaaacccaacttccaccatacccctaaccttttcgcagctccagcgcacagccgccgccgtttcttcatcttcttcgcagagccggcgctccatcttcggctccctcccttacttgcgctcggcacgcaggcggcgctgtggctcgggatctcagtgacggcatcaagggcttcccctcccgcctctcgccagtcgcctccggtcctccgcacaccggccggtgatctctctcctcccgcctccggtggatcgtcaacggcgcccggccccggcggctgcgtcgcgcgcgtcctgagggcagctgcaggcgctgctcgactaaggcggtcgcgccgctttgggagcggtttatgccccaaagtgaagcgtgctcttagtgccgctctttggaaccctggtaatggctactgctgttaaatggctcaaccttcagtcattctagcaactgcaagttatgatcacacaatcagattttgggaagccaagagcggtcgctgttaccgcactattcagtatcctgactctcgagttaatcgccttgagataacccctgacaagcggttcttagctgctgctggcaatcctcatatccgcctttgtgacgtcaactcaaatagccctcagccgg

SEQ ID NO: 36584 - protein, 70 aa, Zea mays
  misc_feature: Ceres CLONE 1420568-F
MAQPSVILATASYDHTIRFWEAKSGRCYRTIQYPDSRVNRLEITPDKRFLAAAGNPHIRLCDVNSNSPQP

SEQ ID NO: 36585 - DNA, 693 bp, Zea mays
  misc_feature: Ceres CLONE 1420575-F
  misc_feature: Translation starting site: 209
  misc_feature (1)..(1): n is a, c, t, g, unknown, or other
  misc_feature (426)..(426): n is a, c, t, g, unknown, or other
  misc_feature (581)..(581): n is a, c, t, g, unknown, or other
  misc_feature (587)..(587): n is a, c, t, g, unknown, or other
naaagctggagctcaccgcggtggcggccgctctaaaactagtggaacccccgggctgcaggaattcgcacgagaccattacctagaacatcctaatcgaaaaaactacctcccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgntggtggggctggccgtggccacgccggtgttcctgatcttcagccccgtgctggtccccgccgcgctgctcatcgggacggccgtcatggggtcccttcacgtcgggcgcgctggggctcgggggcctgtcctcgctcacgtgcctcgccacacngcgcgncaggcgtccagcgcaccccgactacgtggaagagcgcacgcaggaatggcgaagcgccgcgcacgcggccacaggacgcgcaggcaggcaggccatcagggcaggc

SEQ ID NO: 36586 - DNA, 739 bp, Zea mays
  misc_feature: Ceres CLONE 1420577-F
  misc_feature: Encodes the peptide sequence at SEQ ID NO. 36587
aaagctggagctccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagtcgccgccgcgccgcgccgtcgcagcttccgctggcagcagctgcagctccccacccgtgcgcggcagcgagctcgcgctgccgcacgatgggcag

SEQ ID NO: 36587 - protein, 108 aa, Zea mays; identical to SEQ ID NO: 16131
  misc_feature: Ceres CLONE 1420577-F

SEQ ID NO: 36588 - DNA, 719 bp, Zea mays
  misc_feature: Ceres CLONE 1420578-F
  misc_feature: Encodes the peptide sequence at SEQ ID NO. 36589
  misc_feature (408)..(408): n is a, c, t, g, unknown, or other
  misc_feature (421)..(421): n is a, c, t, g, unknown, or other
  misc_feature (681)..(681): n is a, c, t, g, unknown, or other
caaagctggagctccccgcggtggcggccgctctagaactagtggatcccccgggctgcaggaattcgcacgagaccattacctagaacatcctaatcgaaaactatcttgctccaagcagcaagttccaactcgagtagattcacttcgccactccgttgccctctcctccgccgcccgatcctttccccgtctgagatggcatctccggcatcggcgtcgcttaaggaagccgtgggcagcctcgaccccgacggctttgttggtctcctctccaacctcatcggcgagaccgcacacctgcagaacgacccgccgacctacaggcctcaggaggagcgcgtggcgcagcacgtagtcgacgtgctccgcccgggtgtcgcggacaccggggggcggccccctccnttgtgcggagatnagctacgccgagggcaggaggcacgtcatcgttgaataccccggcacgtcccaggccgggtggctccttcgtcgggatgaaaatgaacttttccctgcaaagggagggagggggatttgatcccttccccaacctttggaaggggggaaagggaaaatttcggggaagggggaacccccaagggtttggaaaatttccacgggggggtcaccaaaaggggggcttttggtaagtaaaaccccccccggaaaaattctggnttggggggggttctccccccagaggagaaaaatccttt

SEQ ID NO: 36589 - protein, 85 aa, Zea mays
  misc_feature: Ceres CLONE 1420578-F
  misc_feature: SWISSPROT Homolog: EC 3.5.1.16 Acetylornithine deacetylase
  misc_feature (75)..(75): Xaa is any aa, unknown, or other
MASPASASLKEAVGSLDPDGFVGLLSNLIGETAHLQNDPPTYRPQEERVAQHVVDVLRPGVADTGGRPPPLCGDXLRRGQEARHR

SEQ ID NO: 36590 - DNA, 739 bp, Zea mays
  misc_feature: Ceres CLONE 1420579-F
  misc_feature: Translation starting site: 541
  misc_feature: SWISSPROT Homolog: EC 1.11.1.7 Peroxidase
aaaactggagctccccgcggtggcggccgctctagaactagtggatcccccgggctgcaggaattcgcacgagaccattacctagaacatcctaatcgaaaaacctaactctctccatttgtaaatctcattctctgttgagctgagttcactaaaatcagaaatggtgtggacgaaggctaaggttaatctagctttgtctctggtcatagttttcatcggcatctctgttgctgatctcaaagtcgggttttactccaatacatgccctcaagccgagtcaatcgtcaaaagagttgtctcgggagcttcgctttccgacggacctctcctcctgcagcatctcgagcccagatgttcaggattcgtccgccgacttgcagcacatcgagtccatcgccctcgacaccgtctccttcgaggagctcctcggccactgcggcgaggcgctcaaagtctacgcgcgccacgccgacgccctccagtcgcacctcgcttcctttggctacgagcccccggacgcacaacaccccgtgatcgatgtggatgtggaagatggagatgtcgggaaggttggggaccctggagatagatgccttagcgtgtcgcgttcagtgctcaggtcgggtaagcggcggtttgatggccacagcgatgcgatattttgaagagtcactgaaggatcttgggttttcagatgcttgtctagccactcttttcttctgaaggcgcactttag

SEQ ID NO: 36591 - DNA, 876 bp, Zea mays
  misc_feature: Ceres CLONE 1420579-R
  misc_feature: SWISSPROT Homolog: EC 1.11.1.7 Peroxidase
aattgggtaccgggccccccctcgaggtcgacggtatcgataagcttttttttttttttttttaaactttagacacacttttgaattgaagatcaaaacattttttttttacaaatgaaccagttttctaagctcattacccgtagaagataattaatatatagatagcatggaagacatactatatatatattacaatttttctaagaaattaaccacttcaaatcttactttctcaattgaaagctgagcaaacccgtcgaatctccccattagaaccagtcttcaaatcaatcttccccatcttcaccatcgccttgacgaaatctgattcgaacgatgggccaaagaggggatttagcaacccaacataggaattaacgatctggcgggttgctacatcctcgtagagacctgcatcggtctgaaacaccgcaaaaacatccctttatattttggtaaaatctgctggtccgaatagcccgctcactgggaccggtcccattgggtatcccgggtggtttatgtcacccatttctgggggggccctgaatggggttaatttcggggtaaaaaaaaactggaattgaatggggccggaattcaggctggggcccccccgggaaaaaaaaattttttaaaaagggcgttttaatccctttaaaaaaaaccaggcccctttgtttcccccataattttttaaccccccccctttgaaaaaagaacaaagtttccttttttggcggggggaagccccccttccccacaggaaacttttacccttaaaaggatttccccaaatcgggaggtgcccttttcaatcaggggggaggtgtcctttttgccccgggggaaaaaattttcaaaaaacccccc

SEQ ID NO: 36592 - DNA, 731 bp, Zea mays
  misc_feature: Ceres CLONE 1420580-F
  misc_feature (362)..(362): n is a, c, t, g, unknown, or other
  misc_feature (407)..(407): n is a, c, t, g, unknown, or other
  misc_feature (486)..(486): n is a, c, t, g, unknown, or other
acaaactggagctccccgcggtggcggccgctctagaactagtggatcccccgggctgcaggaattcgcacgagatcattacctagaacatcctaatcgaaaacattccaaacgagactgtgaaccctcccagctagcccacctccctgctcaagcccagccgtccactgcctggctccctcgtccggtcgttcccgtctccctcctcgcgtcgcgtccaccattgttcctgtcgacgctgcgccgcacggctcacaccgccgacagtgcctcagtcctatcgagcctccctcttcccagatcaggccctagctgggctacagccgcccgcgccgctgccgcatccgtcaccttcacaccgngtgggcgcgcgcgctctctctctctctctgcgacgactggacggnctaccgcagtcgcccccataggcaccacgcccttcgctgatctattccctgggcaagaacgctcccaattaaaaaatcnatggattgcctggtgccgggaatcatccagaaccacatgccaatgccctgggagttcctcccagggaaccctcggggttcccaaaaaaactttttaggggcaaaaacccccccccttaaaaggggcccccaacctagggttttgtcccccaccaaaagtgcccttttgtgtgggggaaatataccctccccccccccccctcggggaaaaaaaaaaaattttgtggggggccccaaaaaaggggg

SEQ ID NO: 36593 - DNA, 769 bp, Zea mays
  misc_feature: Ceres CLONE 1420586-F
  misc_feature: Encodes the peptide sequence at SEQ ID NO. 36594
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
acaagctggagctccccgcggtggcggccgctctagaactagtggatcccccgggctgcaggaattcgcacgagaccattacctagaacatcctaatcgaaaactaattgagcatcgcagaagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccgggtgacagaccattgggggaggtgatgatgctttcaacacctttctcagtgagactggtgctgggaagcacgtgccccgtgctgtttttgttgaccttgaacccactgtcatcgaatgagggaaaacttggaacctaccggcagcttttcccaccctgagcagtttatcagggggaaagggggatccgccaaaaacctttggccgggggcccctacccctttggaaaaggaattgtgtaaccttgccccttgacccccacaaggaaattttcccaaaacgtgcccgggtgccacggggtttccccccctttaacggtgtgggggacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 36594 - protein, 38 aa, Zea mays; identical to SEQ ID NO: 17326
  misc_feature: Ceres CLONE 1420586-F

SEQ ID NO: 36595 - DNA, 667 bp, Zea mays
  misc_feature: Ceres CLONE 1420606-F
  misc_feature: Encodes the peptide sequence at SEQ ID NO. 36596
  misc_feature (605)..(605): n is a, c, t, g, unknown, or other
  misc_feature (606)..(606): n is a, c, t, g, unknown, or other
  misc_feature (642)..(642): n is a, c, t, g, unknown, or other
  misc_feature (643)..(643): n is a, c, t, g, unknown, or other
  misc_feature (645)..(645): n is a, c, t, g, unknown, or other
  misc_feature (647)..(647): n is a, c, t, g, unknown, or other
ggagctccccgcggtggcggccgctctagaactagtggatcccccgggctgcaggaattcgcacgagaccattacctagaacatcctaatcgaaaaattttttttggttggttgttcctctcgctcgccagtcgtcaccaggcagcaggcatcccaatctcgcgagagccagtagcggcggcggcgcttccggcttcgcttgccattggcctccgggatggcgctccgcctccacgacgtcacgctcagcctctccccgacgctcgccgcccgccgccgcagcggcggcagtttcgtcgccctcgcctccatgacctccgccgccgtctccaccaaggaggagaacaagaagccatttgctcctccgagggaggtacatgtccaggttacacattcaatgccatctcacaagatagaaattttccagtcacgtgatgattgggctagacataatatcttgacacatctcaagccaggtcaagaagtcgtgagaggcaggcgatttcggccgagacccatgcgcaccaacgtacttcacatgcttgctggctgcttcatcccgcattgcagagagatcccatgtacggtgtgtggtagacagatgnnccaggttagttctttgggtgcttgccttgacatccnnantncagcgtacccctggagtgga

SEQ ID NO: 36596 - protein, 150 aa, Zea mays
  misc_feature: Ceres CLONE 1420606-F
  misc_feature: SWISSPROT Homolog: EC 1.14.19.2 Acyl-[acyl-carrier-protein] desaturase
  misc_feature (130)..(130): Xaa is any aa, unknown, or other
  misc_feature (142)..(142): Xaa is any aa, unknown, or other
  misc_feature (143)..(143): Xaa is any aa, unknown, or other
  misc_feature (144)..(144): Xaa is any aa, unknown, or other
MALRLHDVTLSLSPTLAARRRSGGSFVALASMTSAAVSTKEENKKPFAPPREVHVQVTHSMPSHKIEIFQSRDDWARHNILTHLKPGQEVVRGRRFRPRPMRTNVLHMLAGCFIPHCREIPCTVCGRQMXQVSSLGACLDIXXXAYPWSG

SEQ ID NO: 36597 - DNA, 614 bp, Zea mays
  misc_feature: Ceres CLONE 1420611-F
  misc_feature: Encodes the peptide sequence at SEQ ID NO. 36598
  misc_feature (265)..(265): n is a, c, t, g, unknown, or other
  misc_feature (295)..(295): n is a, c, t, g, unknown, or other
ctggagctccccgcggtggcggccgctctagaactagtggatcccccgggctgcaggaattcgcacgagaccattacctagaacatcctaatcgaaaaattacactcgcttcccccagccgcacgaaaccctaacgccgccgccgcttcacaggtaaaccgccgccatggtctccggttccggcgtatgcgcgaagcgcatcgtggtggacgcgcgcccacacatgctgggccgcctgtcgtcgattatcgccaaggaactgctncatgggcagaaagtggtcgtcgtccgctgncgagagatctgtatgtcgggtgggctcgtacgccagagaatgagtaccttcgctttcttcgcaagcgatgacacccaggcttccgatgggcccatcccattcccgccccctccagaatctgtgggcaccatccccgggatgatcccccaaaaacaaaaggggggaagggggttttgggagggtcaaaactataaaggggttccccccccctaaaaaaaaaccaaaggcctgggattcccgaaccctttaaagggttggggggttaaacacggaaaaaaaatttgcccctttggggaaattttttagggggggggaagga

SEQ ID NO: 36598 - protein, 113 aa, Zea mays
  misc_feature: Ceres CLONE 1420611-F
  misc_feature (11)..(114): Pfam Name: Ribosomal_L13 Pfam Description: Ribosomal protein L13
  misc_feature (43)..(43): Xaa is any aa, unknown, or other
MVSGSGVCAKRIVVDARPHMLGRLSSIIAKELLHGQKVVVVRXREICMSGGLVRQRMSTFAFFASDDTQASDGPIPFPPPPESVGTIPGMIPQKQKGGRGFWEGQNYKGVPPP

SEQ ID NO: 36599 - DNA, 643 bp, Zea mays
  misc_feature: Ceres CLONE 1420614-F
  misc_feature: Translation starting site: 171
  misc_feature (241)..(241): n is a, c, t, g, unknown, or other
  misc_feature (276)..(276): n is a, c, t, g, unknown, or other
  misc_feature (336)..(336): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaatttncccctcatgctcacaagctcctatagcttcccttnctcccccataccttgcatcaatgatagcttcagtatgtgaaaaacccagctctttcaccntataggctccccagcagcatcgcagcaagcaacatacctttattacccttggttcaacaatcggcagccctatctttggggcaatcattggaacaaaaataaaggaaagaacctgaagaatccttggtacctgtgatcacccaattgtcttggaaaacctttttcctatttcaagaaaaaaaattttttccctttaaccaattgttaaatttgaacgggcgtttttttttggggaaaaaaattttaccttttggcgggtttttttttggtttttttttaaaaaaaaaaattttttcctttaaaaaaa

SEQ ID NO: 36600 - DNA, 646 bp, Zea mays
  misc_feature: Ceres CLONE 1420615-F
  misc_feature (621)..(621): n is a, c, t, g, unknown, or other
  misc_feature (633)..(633): n is a, c, t, g, unknown, or other
  misc_feature (634)..(634): n is a, c, t, g, unknown, or other
  misc_feature (639)..(639): n is a, c, t, g, unknown, or other
  misc_feature (646)..(646): n is a, c, t, g, unknown, or other
gctccccgcggtggcggccgctctagaactagtggatcccccgggctgcaggaattcgcacgagaccattacctagaacatcctaatcgaaaaaccagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaaactgaagcggggcacaggaagaggagaagccaagcanggagagggtccnngcgcnaatgacn

SEQ ID NO: 36601 - DNA, 650 bp, Zea mays
  misc_feature: Ceres CLONE 1420623-F
  misc_feature: Encodes the peptide sequence at SEQ ID NO. 36602
aaagctggagctccccgcggtggcggccgctctagaactagtggatcccccgggctgcaggaattcgcacgagaccattacctagaacatcctaatcgaaaaaaaaaaaaaaaaaaaaggcggagaagccaacgataccatccttgctcaaaaattcaaactccgataacctctcacgcgcctccctacgcgcaacgatcccaaattttcaaacgatggagccggcgaaggtagattccgatgcgaagactgtcaaggatccgaatccgagcgccgatccgaaagccgcggatcaaggaccggcgaagaaggtaggcgaggacgcgaacgccgagatcgccttgtcggaggtcgaaatcgagacgaaagggatcgatccagcagcggcgcaggcggaagcgcagccgccggcgaggacgtcgtctggatcgaagaaatcggtgcactggagccccgagctggtgtccgggtctcaggagccggatcagaagtccgcttcgtcgtacccggcgggatctaatccgtatattgctcgttctccggctgagacgtcggatgcttccttgaaagatacgatggagtctgtgaaaggagcgcttgggagatggggaaaaggagggttgctgaagctgctaagaagacggagagcc

SEQ ID NO: 36602 - protein, 145 aa, Zea mays
  misc_feature: Ceres CLONE 1420623-F
MEPAKVDSDAKTVKDPNPSADPKAADQGPAKKVGEDANAEIALSEVEIETKGIDPAAAQAEAQPPARTSSGSKKSVHWSPELVSGSQEPDQKSASSYPAGSNPYIARSPAETSDASLKDTMESVKGALGRWGKGGLLKLLRRRRA

SEQ ID NO: 36603 - DNA, 708 bp, Zea mays
  misc_feature: Ceres CLONE 1420636-F
  misc_feature: Encodes the peptide sequence at SEQ ID NO. 36604
  misc_feature (708)..(708): n is a, c, t, g, unknown, or other
tggagctccccgcggtggcggccgctctagaactagtggatcccccgggctgcaggaattcgcacgagaccattacctagaacatcctaatcgaaaaagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagaggtccgtaccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcagagaccacttcccgtcttcctcccgtggcctgtctgtcatctggctctgaaacgatggcagtcctgcaagttgctgctgctgcccctccccctgtctctgtgattgggttcgagggatttgagaagn

SEQ ID NO: 36604 - protein, 51 aa, Zea mays; identical to SEQ ID NO: 13325
  misc_feature: Ceres CLONE 1420636-F
  misc_feature (1)..(51): Pfam Name: AdoMetDC_leader Pfam Description: S-adenosyl-l-methionine decarboxylase leader peptide

SEQ ID NO: 36605 - DNA, 678 bp, Zea mays
  misc_feature: Ceres CLONE 1420644-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (187)..(187): n is a, c, t, g, unknown, or other
  misc_feature (191)..(191): n is a, c, t, g, unknown, or other
  misc_feature (192)..(192): n is a, c, t, g, unknown, or other
  misc_feature (207)..(207): n is a, c, t, g, unknown, or other
  misc_feature (227)..(227): n is a, c, t, g, unknown, or other
  misc_feature (395)..(395): n is a, c, t, g, unknown, or other
  misc_feature (404)..(404): n is a, c, t, g, unknown, or other
  misc_feature (415)..(415): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactggggactccaccncggnntggcggccgctctanaactagtggatcccccgggnctgcaggaattcgcacgagaccattacctagaacatcctaatcgaaaagccggcgatcggcggagatccgctgttctgacatcgtctcccgctgctgacttgtgaacaaggcagcagcatggttcagtttggaaacatgtcatcaaaagagatagagttggatcacanggacatggntcccatgattnctgctatccgactaacttatggcaaagcggcccttggcccactggccttcccttcagaattcttaacggtggaagaatccattcaaccctttgggcgccccgggcaaattgccccccattccccaggggttccttggggaaacccctttttaagggggcccccccaatgggggccccttggtttgggccggtgttttctttgggggcccccctccacaaaagtttggggggggtttttcccttttggttttcgggggcgaatt

SEQ ID NO: 36606 - DNA, 636 bp, Zea mays
  misc_feature: Ceres CLONE 1420659-F
  misc_feature: Encodes the peptide sequence at SEQ ID NO. 36607
atagctggagctccccgcggtggcggccgctctagaactagtggatcccccgggctgcaggaattcgcacgagaccattacctagaacatcctaatcgaaaagccaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggccagcagcaggtcctgtccgggatgaactaccgcctctacgtcgacgccgccgaccccgtcggccgcaccgtgccctacgtcgccgtcgtgtacgagcaggtctggacccgcacccgccagctcgcttccttcaccccggagccccgcgccccctagaaccatacagacacgggtgggccgaagctaccacaactatgttctccgtcaattacgtgtcgagctcatcattata

SEQ ID NO: 36607 - protein, 130 aa, Zea mays
  misc_feature: Ceres CLONE 1420659-F
MATHRHCLPLLLVAAALALAAVPARAALGGGRGPLLGGWNPIPDVSDSHIQELGGWALGQAKHQKLAADGLRFRRVVRGQQQVLSGMNYRLYVDAADPVGRTVPYVAVVYEQVWTRTRQLASFTPEPRAP

SEQ ID NO: 36608 - DNA, 628 bp, Zea mays
  misc_feature: Ceres CLONE 1420661-F
  misc_feature: Encodes the peptide sequence at SEQ ID NO. 36609
  misc_feature (236)..(236): n is a, c, t, g, unknown, or other
  misc_feature (431)..(431): n is a, c, t, g, unknown, or other
  misc_feature (451)..(451): n is a, c, t, g, unknown, or other
  misc_feature (512)..(512): n is a, c, t, g, unknown, or other
gcggtggcggccgctctagaactagtggatcccccgggctgcaggaattcgcacgagaccattacctagaacatcctaatcgaaaataactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccnacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgaacgcctccccgtgtgggctggccgtgcccacnccggtgttcctgatcttcancccccgtgctggttcccgccgcgctgctcatcggggacggcggtcatggggtccctcaccntcgggccccctggggcctccgggggcctttcctcccctcacgtgccctccccaaacacgggcggggaagggttttccacgcccccccccggaaattaggggagagaaggggccccc

SEQ ID NO: 36609 - protein, 116 aa, Zea mays
  misc_feature: Ceres CLONE 1420661-F
  misc_feature (58)..(58): Xaa is any aa, unknown, or other
MGEQVKGMLHDKGPTASQALTVATLFPLGGLLLVLSGLALNASPCGLAVPTPVFLIFXPRAGSRRAAHRGRRSWGPSPSGPLGPPGAFPPLTCPPQTRAGKGFPRPPPEIRGEKGP

SEQ ID NO: 36610 - DNA, 620 bp, Zea mays
  misc_feature: Ceres CLONE 1420666-F
  misc_feature: Encodes the peptide sequence at SEQ ID NO. 36611
  misc_feature (620)..(620): n is a, c, t, g, unknown, or other
aaagctggagctccccgcggtggcggccgctctagaactagtggatcccccgggctgcaggaattcgcacgagaccattacctagaacatcctaatcgaaaaagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcggacgcgccacctggagccactgttcgccgcgccctccgcatctccgacctctacatctccatccgcggaagcagaccacctccaatccttctttttcacgcagtcattgcttgcctccttagcccaactgttggtaccagaggttcatgtttcatcataaggaatgaacagtagtcgacaaatggaactccactacataaacactggatttccatacacaatcaccgagagcttcatggatttctttgagggtctcacttttgctcatgctgactttgctctcacggatggctttcaggatcagggtaatccatn

SEQ ID NO: 36611 - protein, 50 aa, Zea mays
  misc_feature: Ceres CLONE 1420666-F
MNSSRQMELHYINTGFPYTITESFMDFFEGLTFAHADFALTDGFQDQGNP

SEQ ID NO: 36612 - DNA, 635 bp, Zea mays
  misc_feature: Ceres CLONE 1420672-F
  misc_feature: Encodes the peptide sequence at SEQ ID NO. 36613
aaagctggagctccccgcggtggcggccgctctagaactagtggatcccccgggctgcaggaattcgcacgagaccattacctagaacatcctaatcgaaaaaaaaaatgagcacgaacctgggaggagcctcttgcttcggcttcggcttgactcagctgcagcccgccgccgttaggctccggttgccgcctgctcgcgccgcggacacttcgtcctcccagtcgccggcgcgcctgacggcggtgctggagcaggtggaccagttgctaagccaggggaacgacatggccgcgctctccctcgtgcgcagtacgcaggggggtgacggcgggctccgggcctttggcgccgccaggcagcatgaagctggtcacttcttgatagcttacttgcttggagtgcttccaaaaggatacacaatcacaagcttagatacacttatgaatcaaggatcgcttaatgtgcaagctggagcagcttttgtggactatgagttccttgaagagatcaatacaggcaagctatctgccacgatggttaacaagttctcgtgtatagcactagccggagttgcagcagagtatcttctgtatggacgtgcaggaggaggattagccgacatcaataagctt

SEQ ID NO: 36613 - protein, 176 aa, Zea mays
  misc_feature: Ceres CLONE 1420672-F
MSTNLGGASCFGFGLTQLQPAAVRLRLPPARAADTSSSQSPARLTAVLEQVDQLLSQGNDMAALSLVRSTQGGDGGLRAFGAARQHEAGHFLIAYLLGVLPKGYTITSLDTLMNQGSLNVQAGAAFVDYEFLEEINTGKLSATMVNKFSCIALAGVAAEYLLYGRAGGGLADINKL

SEQ ID NO: 36614 - DNA, 664 bp, Zea mays
  misc_feature: Ceres CLONE 1420677-F
  misc_feature: Encodes the peptide sequence at SEQ ID NO. 36615
taaaactggagctccccgcggtggcggccgctctacaactagtggatcccccgggctgcatgaattcccacgagaccattacctagaacatcctaatcgaaaaacagcgccaagggcaccaccagcaaggaccaagacagagcacagcgcagctcgtcggcctctcgacgccggttgctgcaaccaccgcctttattgcccacgcgggccgtgcggaagaagcaagaagacacgccaatggaggtcgccgcagcatcggcagcgggctacggattcaaggccgacgacgacgttgacagcctcagggcgacagagctcaggcttggcctgccgggcacggaggaagaggaggccgaggagtcccagaacaaggcgccacccccgccgccgtcgaccccccgaggcaagaagcgcgacgccgtccccagccagcggccccaaggtgccccccaaaagcgcgaactgcgagaccgacccccatgccgcggcctccgtctgccccccaaggctcagccgggggggatcgtccgtcgggcgacggcccaccccgacacagctggttttccgcccggcaggcgggcgggccaagaccctacttccgcctgcccgtcactgggcggcacgaagagcaccggcgccgccccgttgggcttcttcgctgtca

SEQ ID NO: 36615 - protein, 142 aa, Zea mays
  misc_feature: Ceres CLONE 1420677-F
MEVAAASAAGYGFKADDDVDSLRATELRLGLPGTEEEEAEESQNKAPPPPPSTPRGKKRDAVPSQRPQGAPQKRELRDRPPCRGLRLPPKAQPGGIVRRATAHPDTAGFPPGRRAGQDPTSACPSLGGTKSTGAAPLGFFAV

SEQ ID NO: 36616 - DNA, 682 bp, Zea mays
  misc_feature: Ceres CLONE 1420678-F
aaagctggagctccccgcggtggcggccgctctagaactagtggatcccccgggctgcaggaattcgcacgagaccattacctagaacatcctaatcgaaaattccccatctccggataaaagagaaggagtgtctctcctatgccatcctcctctctttcagctgagtcgctgccccctctcattttcttacattcaggtccacgcagctcctcacttttttcttgattctgacgatctgcgagccgaccgagtacaggactcttcattacctcaaggaactcttgcaggctgcccctctggtttcctcgaattcatgttccccaaggcctcctcctgtccccacatagattcgtccgtccgaggagcacaccgtccccacccccatgtttacccaccagtatctctgacggacgccgagctccaatgaaactgaacgtgctccgaatccgacgctcccactccttctccgacgccttcctctactggtgctacgtctatcacatgaactcatcgcccctctccaactaatgatccttcgccgtctcaccctcgctctttctctctgagacagtcatacaaagacaactctagggatactgattctgagaatcgtttggccgacccaaccgaagacataaaatgtttaagctgacaagactagccaccatgtcgtcgtgag

SEQ ID NO: 36617 - DNA, 679 bp, Zea mays
  misc_feature: Ceres CLONE 1420682-F
  misc_feature: Encodes the peptide sequence at SEQ ID NO. 36618
aaagctggagctcaccgcggtggcggccgctctagaactagtggatcccccgggctgcaggaattcgcacgagaccattacctagaacatcctaatcgaaaaagatcagatacatccatccattcgcggaccggaaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactggctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattccgtgctcaacgcgctgaacatgacctcccccaagggcggcggcgaccccccgcgggggttccgggagaaacccaggaacgccgagaagccgaccaagtacgccggccgccccaaaagcaacgctccccgcgtgatccaccagcctccctagggtcgctgggggaactcaccaggaaggctgctgcccttcttgcagccttgctcctggctggcggcccgctgtcgggtctgctcttttcacgcctaagcacc

SEQ ID NO: 36618 - protein, 140 aa, Zea mays
  misc_feature: Ceres CLONE 1420682-F
MSAVAVSSSLNPDAPLFIPAALLQVEDFSPQWWDLITTTGWFRDHWSRERAHLDEMAEQIDAAGLLPDDEDLFYDDQLEQGPVAAALKTDSVLNALNMTSPKGGGDPPRGFREKPRNAEKPTKYAGRPKSNAPRVIHQPP

SEQ ID NO: 36619 - DNA, 625 bp, Zea mays
  misc_feature: Ceres CLONE 1420683-F
  misc_feature: Encodes the peptide sequence at SEQ ID NO. 36620
aagctggagctccccgcggtggcggccgctctagaactagtggatcccccgggctgcaggaattcgcacgagaccattacctagaacatcctaatcgaaaattttcaaggggatttaacttatcacggttatttggggagaaaggggatgaagtgaggttcatctcggctgagcccatgtcagatatcataaccaaattggaggacatagcgaagctgaagagcttcaagttgcggaggaaggactggcgcatctgcctggagggtacaagggaaagagttaaggggccattaacaattggcgcggagatatttgaactcacacctccccttgtcatggtggaggtaaaaaagaaggcaggggataatgaagagtaccagaacttctgtgacaaggaattgaagccagggatgcagcaccttgtccaccatagtggtccgagctccaagtatgctgcttactgatgcccagtagatcgaaaggtagtaatttccactcactttttcttcttatgatgtcactgatgccattctgaataatatttttaatactatttatttccgctaatcacgctaattcaggcatgacctgcttgcattgctgaaaaaaaaaaaaataaagcttt

SEQ ID NO: 36620 - protein, 153 aa, Zea mays
  misc_feature: Ceres CLONE 1420683-F
  misc_feature (34)..(79): Pfam Name: NAF Pfam Description: NAF domain
  misc_feature: SWISSPROT Homolog: EC 2.7.11.1 Non-specific serine/threonine protein kinase
AGAPRGGGRSRTSGSPGLQEFARDHYLEHPNRKFSRGFNLSRLFGEKGDEVRFISAEPMSDIITKLEDIAKLKSFKLRRKDWRICLEGTRERVKGPLTIGAEIFELTPPLVMVEVKKKAGDNEEYQNFCDKELKPGMQHLVHHSGPSSKYAAY

SEQ ID NO: 36621 - DNA, 667 bp, Zea mays
  misc_feature: Ceres CLONE 1420686-F
  misc_feature: Encodes the peptide sequence at SEQ ID NO. 36622
  misc_feature (403)..(403): n is a, c, t, g, unknown, or other
  misc_feature (409)..(409): n is a, c, t, g, unknown, or other
  misc_feature (458)..(458): n is a, c, t, g, unknown, or other
  misc_feature (462)..(462): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcagacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagaggaatgcnagagcnagtgccccgagcgcacccagcagctgacccgggcgaagacggcaacagncgcntggacccctacttcccccgttccgggaggggcaagtgggcgggcccggtgcttgccccccccagagggccacccgtgggaaacccaagaaggcttgggggggggccccccccccaggattggccccttaaatgaaaaaaaatttctgcccggcaacaaaaaggcgggaaatccccgggaaggggccgcccccccccccggggggg

SEQ ID NO: 36622 - protein, 73 aa, Zea mays
  misc_feature: Ceres CLONE 1420686-F
MGKGSVGASWWAFLLLAGVLLVVAATAGAEDGVVERDRKEDLRWCKQACEWQYGKDTPRKRNARASAPSAPSS

SEQ ID NO: 36623 - DNA, 580 bp, Zea mays
  misc_feature: Ceres CLONE 1420692-F
  misc_feature (175)..(175): n is a, c, t, g, unknown, or other
  misc_feature (212)..(212): n is a, c, t, g, unknown, or other
  misc_feature (426)..(426): n is a, c, t, g, unknown, or other
aaagctggagctccccgcggtggcggccgctctagaactagtggatcccccgggctgcaggaattcgcacgagaccattacctagaacatcctaatcgaaaaacctttagcgttagcacagacacacacaggtaaggagagcgagaggtgggttgggtttgatcggagacagggnacgagcagagcatgggtagggggcccatcacagattnccaaattttggatttctgtttgcctcgctcaccaaaatggaagggactccaccaccaaacccccctccaggcgttggttgctcccctccccgggactaacttttttcctggggttccccaccggtttcccaatcccccaaatccccccctcttttcccccccccggaatagggtttttgggaaaaattttttttttcgcgggattttttttttncccaagaaaaagggcgcccaccaaattttttggggtggtttttttcccccctttttataaaaacccccccggcccccccaaaagggggttcccaacctctttcttttagaggggggggggaaaaaaaccccccttttttttttttttttttcct

SEQ ID NO: 36624 - DNA, 663 bp, Zea mays
  misc_feature: Ceres CLONE 1420694-F
  misc_feature: Translation starting site: 255
aaaaactggagctccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctggctggagagcagtttacatgaaaagataattgaggcatgcaacaaccttattgcaaagctcaagtaagtgaggtagtcacgaatggctcagttgatgaattccctgaatcacatttcccatatggctcggaacaacggtttgggtggaaatgccccactggagtatgcaagctttacaataagatttggctcattgaa

SEQ ID NO: 36625 - DNA, 647 bp, Zea mays
  misc_feature: Ceres CLONE 1420695-F
  misc_feature (187)..(187): n is a, c, t, g, unknown, or other
  misc_feature (189)..(189): n is a, c, t, g, unknown, or other
  misc_feature (190)..(190): n is a, c, t, g, unknown, or other
  misc_feature (197)..(197): n is a, c, t, g, unknown, or other
  misc_feature (199)..(199): n is a, c, t, g, unknown, or other
  misc_feature (200)..(200): n is a, c, t, g, unknown, or other
  misc_feature (284)..(284): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (436)..(436): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (457)..(457): n is a, c, t, g, unknown, or other
  misc_feature (541)..(541): n is a, c, t, g, unknown, or other
  misc_feature (542)..(542): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (630)..(630): n is a, c, t, g, unknown, or other
  misc_feature (640)..(640): n is a, c, t, g, unknown, or other
  misc_feature (641)..(641): n is a, c, t, g, unknown, or other
tggagctccaccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaacagagcaacaatggcgaccaagatattttccctncnncttatgncnntccttgcgtctttctgcatgtgttgctaacgcgacaattttgccccttcaaatggggggttaacccaagccccctataaccttnttnnncttttttttccccataaccatttcaaaaaaaggagagaggcctctggggggggggggaaaaaccccccttttttttttggccccatataggggggccgcaccaaaagagatatattttccgcgggaggaaaaatactttttttttcnccnnnnnnncccccctcgctnttattttaattgaataggtcccggcgttccgccttcgtccccctcatccctgcggccgcgcgcccccacgcccccccccgcttnngtgcccgccgcgcccgtgtgtctttctcgcgtgtctcgcttactcccggcaccattnnnnnnncnnncctccccttcctcctcgggtntgggcggcgnngcggtg

SEQ ID NO: 36626 - DNA, 844 bp, Zea mays
  misc_feature: Ceres CLONE 1420699-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (310)..(310): n is a, c, t, g, unknown, or other
  misc_feature (312)..(312): n is a, c, t, g, unknown, or other
  misc_feature (313)..(313): n is a, c, t, g, unknown, or other
  misc_feature (346)..(346): n is a, c, t, g, unknown, or other
  misc_feature (529)..(529): n is a, c, t, g, unknown, or other
  misc_feature (561)..(561): n is a, c, t, g, unknown, or other
  misc_feature (562)..(562): n is a, c, t, g, unknown, or other
  misc_feature (574)..(574): n is a, c, t, g, unknown, or other
  misc_feature (616)..(616): n is a, c, t, g, unknown, or other
  misc_feature (641)..(641): n is a, c, t, g, unknown, or other
  misc_feature (646)..(646): n is a, c, t, g, unknown, or other
  misc_feature (667)..(667): n is a, c, t, g, unknown, or other
  misc_feature (674)..(674): n is a, c, t, g, unknown, or other
  misc_feature (678)..(678): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactgggagctccaccgncnngtggcggccgctctagaactagtggaatccccncgggctgcaggaattcgcacgagaccattacctagaacatcctaatcgaaaaacagcatctcaagccaccatcgaccttcaagtctcgctacgtagcagtgcaataaaaaaagcagccgcaatggcgagcagcaccatggccctctcctccacggccttcgccggcaagggccgtgaacgtgnccgtcgtccgtccccgccttcggcgagggccnncgcgtgacgaantgcgcaagaacgggcggcgaaaaggccaaaagccaggcgggncggggcgtcccggggaagcccccgntgggntaccgggccccccgaacccgncggtggnctgntacccctgggggccccccacctggtcccggggcgaaagcccaacccggaggcttacccttgaacgggggcgaaaggtttccccgggggcggaacttaccgggcctggggggaacacccggccgggggggctttgttccggcccgggaaacccccggaaaaaaactt

SEQ ID NO: 36627 - DNA, 714 bp, Zea mays
  misc_feature: Ceres CLONE 1420721-F
  misc_feature: Encodes the peptide sequence at SEQ ID NO. 36628
  misc_feature (714)..(714): n is a, c, t, g, unknown, or other
aaagctggagctccccgcggtggcggccgctctagaactagtggatcccccgggctgcaggaattcgcacgagaccattacctagaacatcctaatcgaaaactctccagtctccagcctccatcagtccaggtcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcgggagacggtcgagcagagcgatgacggattggtgagcttgcccttgatatgctccttctcgcggatgaagtcccacctggggctggacgcagatgtcaagcccgagactgtgccggaggagaccgtgcttgcggttgctgaggtgctccggccttctcctgccctccgcgtatcggaggatggaaagaagattggtagagctagtgaactcttgaagccagatgagatcatagaacaagtagactctaggactattgctgtatctccgctgccttgcaatgtaaagcaggaagacgtccaatcttttctcacaaattatgcaaaggtaaatagcgtgagacttccacgcagtattgccaacaaaaaacacttctgtgagactgctttgcgtgagttttctgaagaagaagaagcaaaagaattatggcgactgctttagtactn

SEQ ID NO: 36628 - protein, 182 aa, Zea mays
  misc_feature: Ceres CLONE 1420721-F
  misc_feature (17)..(89): Pfam Name: La Pfam Description: La domain
MAAPAAAPLDEGKAKKVLRQVEFYFSDSNLPRDKFLRETVEQSDDGLVSLPLICSFSRMKSHLGLDADVKPETVPEETVLAVAEVLRPSPALRVSEDGKKIGRASELLKPDEIIEQVDSRTIAVSPLPCNVKQEDVQSFLTNYAKVNSVRLPRSIANKKHFCETALREFSEEEEAKELWRLL

SEQ ID NO: 36629 - DNA, 656 bp, Zea mays
  misc_feature: Ceres CLONE 1420722-F
  misc_feature: Encodes the peptide sequence at SEQ ID NO. 36630
aaagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttgcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacgggcacgccgtcgtgctctgggagtggtgcaggggcaaaaacagaact

SEQ ID NO: 36630 - protein, 94 aa, Zea mays
  misc_feature: Ceres CLONE 1420722-F
MPAFALVNKATGLAIKHSLGQSHPVKLAPFSPDQEDASVLWTESKDVGKGFRCIRMVNNTRLNFDAFHGDKDHGGVHDGHAVVLWEWCRGKNRT

SEQ ID NO: 36631 - DNA, 712 bp, Zea mays
  misc_feature: Ceres CLONE 1420723-F
  misc_feature: Encodes the peptide sequence at SEQ ID NO. 36632
aaagctggagctccccgcggtggcggccgctctagaactagtggatcccccgggctgcaggaattcgcacgagaccattacctagaacatcctaatcgaaaatttttttttttttttttccccacacgcgcccacctcctccggtcctcccctctagtcctctctcccgaccccacctctgccgtccgtgcgtccgtccggcaaccgcgacgcaacaatggcggccgggcgagagctggtggtgagtttcggcgagatgctgatagacttcatgccgaccgtggcgggggtctcgctggccgaggcgccggccttcctcaaggcggccgggggcgcgcccgccaacgtcgccatcgcggtctcgcgcctcggtggcggggccgccttcgttggcaagctcggcgacgacgagttcggccgcatgctcgccgccatcctccgcgacaacggagtcgacggcggcggcgtcgtcttcgacgcgggcgcgcgcaccgagcttgccttcgtcaccctgcgcgccgactgcgagagcgagttcatgttctaccgcaaccccagcgccgacatgctcctcactgccgacgagctcaacgtcgggctcatccggagggatgcggactttcactacggatcaataagcttgattgctgagccttgccggacagcacatctccgtgacatggaaattgccaaagaggctgttgcactgctc

SEQ ID NO: 36632 - protein, 165 aa, Zea mays
  misc_feature: Ceres CLONE 1420723-F
  misc_feature: SWISSPROT Homolog: EC 2.7.1.4 Fructokinase
MAAGRELVVSFGEMLIDFMPTVAGVSLAEAPAFLKAAGGAPANVAIAVSRLGGGAAFVGKLGDDEFGRMLAAILRDNGVDGGGVVFDAGARTELAFVTLRADCESEFMFYRNPSADMLLTADELNVGLIRRDADFHYGSISLIAEPCRTAHLRDMEIAKEAVALL

SEQ ID NO: 36633 - DNA, 646 bp, Zea mays
  misc_feature: Ceres CLONE 1420733-F
  misc_feature: Encodes the peptide sequence at SEQ ID NO. 36634
  misc_feature (470)..(470): n is a, c, t, g, unknown, or other
aaagctggagctccccgcggtggcggccgctctagaactagtggatcccccgggctgcaggaattcgcacgagaccattacctagaacatcctaatcgaaaaatcttatcatccgccgccaatgctgcgccgcaacccaacccgcatcgagctcacctcctccgaccgcgacgagctcgaagaccacctccgcgccgccgcggcgagctccaccaaggatccttccggttacaccactccgtctccagtccttggcccgcagacctccaatcccctgctccaattcctccacccgaagcccggcgccgcgccatccaagtcccaacgcatcggcatcggcctctccaccccgccggctccggccccgaacccgcgaccaccccatccacctcatggaggttgagatcaagctccgcctccccgacgccgccgcgcaccgccgcctgtccgcgttcctcgcgccccgcctncgccgcacccacgcccaggggaacctcttcttcgacgacgccgcgcgcacgctcggagccgccaccgccgcgctccgcgtccgcctctacgacgggcccgacgacggggggccctcgcgcgccgtcctcgcgctcaagcgccgcccgcggatcgaggccggcgtcagccgcgtcga

SEQ ID NO: 36634 - protein, 84 aa, Zea mays
  misc_feature: Ceres CLONE 1420733-F
MEVEIKLRLPDAAAHRRLSAFLAPRLRRTHAQGNLFFDDAARTLGAATAALRVRLYDGPDDGGPSRAVLALKRRPRIEAGVSRV

SEQ ID NO: 36635 - DNA, 666 bp, Zea mays
  misc_feature: Ceres CLONE 1420745-F
  misc_feature: Encodes the peptide sequence at SEQ ID NO. 36636
  misc_feature (506)..(506): n is a, c, t, g, unknown, or other
  misc_feature (559)..(559): n is a, c, t, g, unknown, or other
agagctggagctccccgcggtggcggccgctctagaactagtggatcccccgggctgcaggaattcgcacgagaccattacctagaacatcctaatcgaaaaacggaagtttcggcggcgccggcgtgctcgtgatctcaaccaaggcgtgtctccgctccggtcacccgtcactccacgcaaacatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgtgccaccggagcaaacagaccaagacccccngaccctgtgccagtctgccctcagggcgcttgctcgttctgggatgaaaatcngacgcattgaggacgtaccccggtccccagggaagcacttccaaaaaggccgtaggaggggaagggaagcttaagcttctttggcggtctttgggggattaaacctt

SEQ ID NO: 36636 - protein, 127 aa, Zea mays
  misc_feature: Ceres CLONE 1420745-F
  misc_feature (28)..(108): Pfam Name: Ribosomal_S11 Pfam Description: Ribosomal protein S11
  misc_feature (125)..(125): Xaa is any aa, unknown, or other
MSRRKTREPKEENVTLGPTVREGEYVFGVAHIFASFNDTFIHITDLSGRETLVRITGGMKVKADRDESSPYAAMLAAQDVAQRCKELGITALHIKLRATGANRPRPPDPVPVCPQGACSFWDENXTH

SEQ ID NO: 36637 - DNA, 503 bp, Zea mays
  misc_feature: Ceres CLONE 1420750-F
  misc_feature: Encodes the peptide sequence at SEQ ID NO. 36638
  misc_feature (178)..(178): n is a, c, t, g, unknown, or other
  misc_feature (193)..(193): n is a, c, t, g, unknown, or other
  misc_feature (288)..(288): n is a, c, t, g, unknown, or other
  misc_feature (289)..(289): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
aaagctggagctccccgcggtggcggccgctctagaactagtggatcccccgggctgcaggaattcgcacgagaccattacctagaacatcctaatcgaaaaactagctgctctggctcccccgaggcaatcgagtaatcgacgaaggccaccaccacctccacaccactttgcctcngagaaggttccaccnaagcctctcggctagggtttgggggacttttgggggggcgatcccaaattggagggcgccccggcgcgggaaaaaagccctcagagggggggggnnaaaaaaaannnggaaaaaccagggttttgggacccccccgcgggaaaagggggggaaactttaaaacccccccccgggggccgggggggggaaaaatcttccccccttctccccggaagaaagaaaaaatttccccccccccccccgggggaaaacccccccccccttttttggggggggggcccccccccccccgccctaaaaaaaagagaga

SEQ ID NO: 36638 - protein, 45 aa, Zea mays
  misc_feature: Ceres CLONE 1420750-F
KAGAPRGGGRSRTSGSPGLQEFARDHYLEHPNRKTSCSGSPEAIE

SEQ ID NO: 36639 - DNA, 719 bp, Zea mays
  misc_feature: Ceres CLONE 1420752-F
  misc_feature: Encodes the peptide sequence at SEQ ID NO. 36640
  misc_feature (1)..(1): n is a, c, t, g, unknown, or other
  misc_feature (519)..(519): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (530)..(530): n is a, c, t, g, unknown, or other
  misc_feature (541)..(541): n is a, c, t, g, unknown, or other
  misc_feature (544)..(544): n is a, c, t, g, unknown, or other
  misc_feature (547)..(547): n is a, c, t, g, unknown, or other
  misc_feature (553)..(553): n is a, c, t, g, unknown, or other
  misc_feature (554)..(554): n is a, c, t, g, unknown, or other
  misc_feature (566)..(566): n is a, c, t, g, unknown, or other
naaagctggagctccccgcggtggcggccgctctagaactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgtcgcatcggcggcggcaagagcaacgccccgcgactgcgacactactgccgccttcgcggcgggcgacggcagtgccggcgccgtggacgaggacgacgagcaggccaagaccgccgacgtgttcggtgggcggaccggcggcggcggcctcttcggcggcgtccacggcccgctgggcggcggcgtcgctgggttcggcccgttcggcggggccgtcgccggcgcgggcccgttcggcgggttcggaggcggcgcgctcngtgggcnnnanggaagaagaanaanaanaaccanngtggccccggcntcccgtgagtcttgaacaacgctgtgcatggccatggatgcatgcgtgcgtgcgcgtgtaataaggcgtgtctgtactctgtactgtacgtacatgccgtgtgcctgtccgctcttgtgatgaaggattgggcgtacgtatgtcggtatgtgc

SEQ ID NO: 36640 - protein, 123 aa, Zea mays
  misc_feature: Ceres CLONE 1420752-F
  misc_feature (104)..(104): Xaa is any aa, unknown, or other
  misc_feature (106)..(106): Xaa is any aa, unknown, or other
  misc_feature (107)..(107): Xaa is any aa, unknown, or other
  misc_feature (111)..(111): Xaa is any aa, unknown, or other
  misc_feature (112)..(112): Xaa is any aa, unknown, or other
  misc_feature (113)..(113): Xaa is any aa, unknown, or other
  misc_feature (115)..(115): Xaa is any aa, unknown, or other
MAAKWWLVASLLLCLAVASAAARATPRDCDTTAAFAAGDGSAGAVDEDDEQAKTADVFGGRTGGGGLFGGVHGPLGGGVAGFGPFGGAVAGAGPFGGFGGGALXGXXGRRXXXTXVAPASRES

SEQ ID NO: 36641 - DNA, 738 bp, Zea mays
  misc_feature: Ceres CLONE 1420755-F
  misc_feature: Encodes the peptide sequence at SEQ ID NO. 36642
  misc_feature (423)..(423): n is a, c, t, g, unknown, or other
  misc_feature (494)..(494): n is a, c, t, g, unknown, or other
  misc_feature (497)..(497): n is a, c, t, g, unknown, or other
aagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcaggncgcttcatggggaagagagtggtgtttctcaagcagctcaagtctggcctgctccttatctctgggccttncangatcaatgagtaccgatccgccgtgggaacagaacttttgtctggctacatcaaccaaagtgaactccctgggggtgaatgccccccaatttaaagaaaaatccttttcccgggaaaaaaaaacaaaagggaaaaaaacccgggggcaactttttaaaaacaaaagggggggtcccaatctcttgcctgttcctaaaaaggaaaaccaaaaggtgggggatttcttttaaaaaaaggttta

SEQ ID NO: 36642 - protein, 141 aa, Zea mays
  misc_feature: Ceres CLONE 1420755-F
  misc_feature (1)..(49): Pfam Name: Ribosomal_L6e_N Pfam Description: Ribosomal protein L6, N-terminal domain
  misc_feature (110)..(110): Xaa is any aa, unknown, or other
  misc_feature (111)..(111): Xaa is any aa, unknown, or other
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGPXXINEYRSAVGTELLSGYINQSELPGGECPPI

SEQ ID NO: 36643 - DNA, 690 bp, Zea mays
  misc_feature: Ceres CLONE 1420757-F
  misc_feature: Encodes the peptide sequence at SEQ ID NO. 36644
  misc_feature (683)..(683): n is a, c, t, g, unknown, or other
cagagctggagctccccgcggtggcggccgctctagaactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgttcgatgatttcgagaggttcgcacccacgacggccacagtgagctcgtcgctgctgcttgggatcactgggctcccagacactaagttcaagagtgcgatagatactgcactggcagatggtgagtgcaacgcactggagaaggctgaggacaggatgtcctgttacctcaccaaggctcttgcaaatgttggcgctgaactggctcatcaagtccctgggagagtttcgacggaaatagatgctcggttagcttatgacacccagggcataatccacagggtacatgaactgttgaatctatacnaccaaca

SEQ ID NO: 36644 - protein, 180 aa, Zea mays
  misc_feature: Ceres CLONE 1420757-F
  misc_feature: SWISSPROT Homolog: EC 2.2.1.2 Transaldolase
  misc_feature (179)..(179): Xaa is any aa, unknown, or other
MALSIYTPTSSSLVPPSIQEVRLTSRPPKPATFSLRRPHLAARAAAGNAPTSPVREVVTELDAVAGFSEIVPDTVVFDDFERFAPTTATVSSSLLLGITGLPDTKFKSAIDTALADGECNALEKAEDRMSCYLTKALANVGAELAHQVPGRVSTEIDARLAYDTQGIIHRVHELLNLYXQ

SEQ ID NO: 36645 - DNA, 631 bp, Zea mays
  misc_feature: Ceres CLONE 1420772-F
  misc_feature: Pfam Name: GDPD Pfam Description: Glycerophosphoryl diester phosphodiesterase family
aaagctggagctccccgcggtggcggccgctctagaactagtggatcccccgggctgcaggaattcgcacgagaccattacctagaacatcctaatcgaaaaattcgctaacgctgttgtcatcgtaaaaacatcagtctttcccttatttgatgatggattcatcattaggcaaaccaatgttgtggagaagctgcacaagtctaagctcccggtttatgtggagctgtttcagaacgagtttgtatctcaaccattcgacttcttctctgatccaaccgttgagataaactcttatgtcagcggagctggtatcgatggaaccatcacagagtttcctttcacagctgcaagatacaaaaggaatcgatgtttgggaacaaaagaaactataccaccacaatacatgtcccctgttccaccgggacttttcttaaaccttgtgaatgccatacctccagcccaagctccaaacccggttttcacagatgatgatgtaactgagccaccactacctccggttacagcaaaatctccaacctcggcacctggaacctcattcaccaatgcacaagcacctaggtctagcggacaaactcgactcactctatctcttcgcctctctgttttc

SEQ ID NO: 36646 - DNA, 622 bp, Zea mays
  misc_feature: Ceres CLONE 1420779-F
  misc_feature: Encodes the peptide sequence at SEQ ID NO. 36647
tggagctccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagacaaagagagagagagacatagactcggactcggagagaaggagatgatgtcgagggagcgcaagaaggcggctgctcttcaggagaagctgaaaatcctccgctccatcactcactcccacgctctgagcaacacgtcaataatcatggacgcgtcggcgtacatcaaggagctgaagcagaaggtggtgaggctgaaccaggagattgcgtgcgcgcaagacgcactgagacacaaagcatcatcctatcccacagtgaccgtggaagccctaggagtgcaggggtcgtcgttcctggtgaacgtgttctccgacaagagctgcccggggctgctcgtctccgtgctggaggccttccaccagctggtgctcagcgtgctccaggccaccgcgtcctgcgccgactccttccg

SEQ ID NO: 36647 - protein, 123 aa, Zea mays
  misc_feature: Ceres CLONE 1420779-F
MMSRERKKAAALQEKLKILRSITHSHALSNTSIIMDASAYIKELKQKVVRLNQEIACAQDALRHKASSYPTVTVEALGVQGSSFLVNVFSDKSCPGLLVSVLEAFHQLVLSVLQATASCADSF

SEQ ID NO: 36648 - DNA, 640 bp, Zea mays
  misc_feature: Ceres CLONE 1420785-F
  misc_feature: Encodes the peptide sequence at SEQ ID NO. 36649
  misc_feature (594)..(594): n is a, c, t, g, unknown, or other
tggagctccccgcggtggcggccgctctagaactagtggatcccccgggctgcaggaattcgcacgagaccattacctagaaaatcctaatcgaaaaggagcatcaccgttcactggataattcgctcgctccgctcgatgcccgcttgtttgcggtgaagcctccggcgaacagccgtagcggaaacgccgcccgagatgtctgctccctccgccccacctcgcacggtgatctgtgtgggcgacgtccacggctacatcacgaagctggagagcctctggtccaacctccaggccgcactccccgccgacgccttcgccaccgcgctggtcatcttcctcggcgactacaacgaccgcggcccgcacacccgcagggtcctcgacttcctcctcgcgctcccgacgcgctaccccgcgcagcgccacgtcttcctctgcggcaaccacgacctcgccttcgcggcgttcgtcggggcgctgccgccgccgcccgacggctccccgttctcggccacctgggacgagtacatccacaacgaggagcacgaggggtggttccgcgggccgggaatcgagggcatgcacgtgcangggaagcggtgggggcgggtcatcaaggagaggtggacccccagga

SEQ ID NO: 36649 - protein, 147 aa, Zea mays
  misc_feature: Ceres CLONE 1420785-F
  misc_feature: SWISSPROT Homolog: EC 3.1.3.16 Phosphoprotein phosphatase
  misc_feature (132)..(132): Xaa is any aa, unknown, or other
MSAPSAPPRTVICVGDVHGYITKLESLWSNLQAALPADAFATALVIFLGDYNDRGPHTRRVLDFLLALPTRYPAQRHVFLCGNHDLAFAAFVGALPPPPDGSPFSATWDEYIHNEEHEGWFRGPGIEGMHVXGKRWGRVIKERWTPR

SEQ ID NO: 36650 - DNA, 632 bp, Zea mays
  misc_feature: Ceres CLONE 1420787-F
  misc_feature: Encodes the peptide sequence at SEQ ID NO. 36651
aagctggagctccccgcggtggcggccgctctagaactagtggatcccccgggctgcaggaattcgcacgagaccattacctagaacatcctaatcgaaaaatcgcataggtccgccgcccctctccctcagtaaacccccctctcttcttcccgcggtctgctcgttcgatctgtgcagcaaatctgaggtctcgagcgaccgtgaagcagcttcaatcgtcggcatggcgctcgtattgcatagtggggctggaaacaagaatgccttcaaagcacttattgctgcagaatacagtgggatcaaggctgagttgaccaaagattttgagatgggtgtctccaacaagacccctgagtttcttaagatgaacccccttgggaaggttcctgttctggagactcctgatggccctgtttttgagagtaatgctatcgcacgctatgttgctcgcttgaaggatgacaaccatctttatgggtcttcccgtattcgacaggcccacgttgagctatggatggattttgccacaacagaagttgatcctggtgttgcatgcaacttgtctgcaaggcttgagtacctcccttatgtcagcactactgaggagacagctatttcttccttgaaaa

SEQ ID NO: 36651 - protein, 135 aa, Zea mays
  misc_feature: Ceres CLONE 1420787-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGAGNKNAFKALIAAEYSGIKAELTKDFEMGVSNKTPEFLKMNPLGKVPVLETPDGPVFESNAIARYVARLKDDNHLYGSSRIRQAHVELWMDFATTEVDPGVACNLSARLEYLPYVSTTEETAISSLK

SEQ ID NO: 36652 - DNA, 585 bp, Zea mays
  misc_feature: Ceres CLONE 1420788-F
  misc_feature (153)..(153): n is a, c, t, g, unknown, or other
  misc_feature (154)..(154): n is a, c, t, g, unknown, or other
ctagctggagctcaccgcggtggcggccgctctagactagtggatcccccgggctgcaggaattcgcacgagaccattacctagaacatcctaatcgaaaagcctggctccctcgtccggtcgttcccgtctccctcctcgcgtcgcgtccanncattggtttcccttggtcgacgctgcgccgcacggctcaaccgccgacagtgcctcagtcctatcgagccctccctctccccagataaggccctaggttgggctaaaagccgcccgccgcccgttgccgcaatccgttcacttttaaaccccgggtggggggcggggggcggttttttttttctttttttttttgggaaaaaatggggatggggggttaccccgaaattccccccccccatatgggacccccacaccccccctttccccgcaaaaaatatttcgccggggggggaaaaaaaaaacccctccccctcctattttaaaaaaaaactctcttttttacaacctccctgggggttcccaacggaaaaaacatacccctcgttaaaaaaataacccccttcccccgcttccctattctaccccccc

SEQ ID NO: 36653 - DNA, 640 bp, Zea mays
  misc_feature: Ceres CLONE 1420789-F
  misc_feature: Encodes the peptide sequence at SEQ ID NO. 36654
aaagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagtacggct

SEQ ID NO: 36654 - protein, 34 aa, Zea mays
  misc_feature: Ceres CLONE 1420789-F
MSSLHATRAELGLVVLYLNKAEARDKICRAIQYG

SEQ ID NO: 36655 - DNA, 509 bp, Zea mays
  misc_feature: Ceres CLONE 1420796-F
  misc_feature: Encodes the peptide sequence at SEQ ID NO. 36656
  misc_feature (280)..(280): n is a, c, t, g, unknown, or other
ctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcancagccagcaaaaacccgggcccccttgaataccgggcttaaaggcccaaaggcccccaactttggggggggccaaaccttggggttttccccggggtaatatccggggccgggccccccatttaaccccccccccccgggggggcccccccccccccgggggggggggggaaatctccctccccccccccggttttgttttgttttggccccccccccccccccccccc

SEQ ID NO: 36656 - protein, 61 aa, Zea mays
  misc_feature: Ceres CLONE 1420796-F
  misc_feature (29)..(29): Xaa is any aa, unknown, or other
MADHHRGATGGGGGYGDLQRGGGMHGEAXQPAKTRAPLNTGLKGPKAPNFGGGQTLGFSPG

SEQ ID NO: 36657 - DNA, 653 bp, Zea mays
  misc_feature: Ceres CLONE 1420809-F
  misc_feature: Encodes the peptide sequence at SEQ ID NO. 36658
aagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaaccactgtcatcgatgaggtgaggactggcacctaccgccagctctttcaccctgagcagctcatcagtgggaaaggaggatgcagccaaacactttggccgggggtcactacaccatttggcaaggaagatggttgacttaggctttgatcccatcaagaaaccttgccaaaaactgcactggtcccccagggtttctcgtcttcaagccttgttgggggagaa

SEQ ID NO: 36658 - protein, 77 aa, Zea mays
  misc_feature: Ceres CLONE 1420809-F
MRECISIHIGQAGIQVGNACWELYCLEHGIQADGQMPGDKTIGGGDDAFNTFFSETGAGKHVPRAVFVDLEPLSSMR

SEQ ID NO: 36659 - DNA, 746 bp, Zea mays
  misc_feature: Ceres CLONE 1420817-F
  misc_feature: Encodes the peptide sequence at SEQ ID NO. 36660
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaacatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgccgcgttggcagcaccccgatcttggggcagtgcgtcgagttcctgagggatcagtggagcccgacggcaacgcctaatggtcccctcantgcccgttctttgcggcaccgtgttgccagcaactcaggcagggggagccccaaccccggacccgggggaatttcgggttgggcccccaggccatcctggaaaaaaacccaaaaagggccaggtcggggggtt

SEQ ID NO: 36660 - protein, 42 aa, Zea mays
  misc_feature: Ceres CLONE 1420817-F
MPVPTAASKPVPAAGNLPRWQHPDLGAVRRVPEGSVEPDGNA

SEQ ID NO: 36661 - DNA, 564 bp, Zea mays
  misc_feature: Ceres CLONE 1420820-F
  misc_feature: Encodes the peptide sequence at SEQ ID NO. 36662
caagctggagctccccgcggtggcggccgctctagaactagtggatcccccgggctgcaggaattcgcacgagaccattacctagaacatcctaatcgaaaaattcttccttccttcttttcttcaccaatggccacgagaatagccttgtgtcttctcggccacgtcctcctcgccgtcgcgtcgatggcagtggcggcggcggccggtgacgcgggcaagatcggcatctgccacggccgcgttggcagtaacctcccgccgccgtcggccgccgcggcactgctcaagcggaacgggatcaccaaggcgcggctccttctggcgggacccggcccggggtcccggggccttcgccggggggggggatccgacccccatgggggggggggggccccactaaggaaaacccccccctttcctggggccccggggggggggcccccagggggggccgggggcaaattggggtttgggggtcccgcgggttttttggggcccccccccccccccccaaaaaaaaagccttcggggggcccctcccccccctgcacaaaaaaaaaa

SEQ ID NO: 36662 - protein, 145 aa, Zea mays
  misc_feature: Ceres CLONE 1420820-F
MATRIALCLLGHVLLAVASMAVAAAAGDAGKIGICHGRVGSNLPPPSAAAALLKRNGITKARLLLAGPGPGSRGLRRGGGSDPHGGGGAPLRKTPPFPGAPGGGPPGGAGGKLGFGGPAGFLGPPPPPPKKKPSGGPSPPCTKKK

SEQ ID NO: 36663 - DNA, 742 bp, Zea mays
  misc_feature: Ceres CLONE 1420821-F
  misc_feature: Encodes the peptide sequence at SEQ ID NO. 36664
aaagctggagctccccgcggtggcggccgctctagaactagtggatcccccgggctgcaggaattcgcacgagaccattacctagaacatcctaatcgaaaaattccgtcgtcgtcatcagcagcttctgcttgctctgggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggcgaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctcgtcgcatccgtaagcctgctcgtcttcctttctttctttctttcgcagcgctgactgtctgtctgtctgtctgtctgtctgtctgtcaggaccc

SEQ ID NO: 36664 - protein, 163 aa, Zea mays
  misc_feature: Ceres CLONE 1420821-F
MLAVFSGQVVEVPAELVAAGSRTPSPKTKASQLVGRFLAASEPAVSVQLGDHGHLAYSHTNQALLRPRSFAAKDEVFCLFEGVLDNLGRLSQQHGLSSKGANEVLLVIEAYKTLRDRAPYPASFMLAQLTGSYAFVLFDKSTNSLLVASVSLLVFLSFFLSQR

SEQ ID NO: 36665 - DNA, 649 bp, Zea mays
  misc_feature: Ceres CLONE 1420824-F
  misc_feature: Encodes the peptide sequence at SEQ ID NO. 36666
  misc_feature (621)..(621): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggccacgcccacgctggccgccgtgcgggcgctctttcagctccgctcccaccgcgcgctgctggccggcaaagggcttccgcttctcacgccgcccacggngcccgcgcccgtgccgctgcgggtcccn

SEQ ID NO: 36666 - protein, 98 aa, Zea mays
  misc_feature: Ceres CLONE 1420824-F
  misc_feature (89)..(89): Xaa is any aa, unknown, or other
MAPLPASLTPCLWLFLCLLAAPCPAARAARFACNATAPRASTCQALVSYAPPNGTATPTLAAVRALFQLRSHRALLAGKGLPLLTPPTXPAPVPLRVP

SEQ ID NO: 36667 - DNA, 672 bp, Zea mays
  misc_feature: Ceres CLONE 1420836-F
  misc_feature (580)..(580): n is a, c, t, g, unknown, or other
  misc_feature (582)..(582): n is a, c, t, g, unknown, or other
tggagctccccgcggtggcggccgctctataactagtggatcccccgggctgcaggaattcgcacgagaccattacctagaacatcctaatcgaaaaatcgcacatattatttcagaccaactgagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttccctcaacaatcatcatccctattacagcagttaccctttggtgcattttatgggaacaaaacatccggggcccaaaaaacaaaaaaactttgggaaaaaaacttgtgccaatttaaacaaaaaaattttttccctaaaacaaaaactggaattaaaccccgctttttttttggacaaccacacattttttccttttttccccgcngnggttttggggcccttcccctcaaaaaaaaaaaattttctttttttttttaaaaaaattggggcggccccaataacaaccccccctttttt

SEQ ID NO: 36668 - DNA, 705 bp, Zea mays
  misc_feature: Ceres CLONE 1420837-F
  misc_feature: Pfam Name: B3 Pfam Description: B3 DNA binding domain
  misc_feature (172)..(172): n is a, c, t, g, unknown, or other
  misc_feature (178)..(178): n is a, c, t, g, unknown, or other
  misc_feature (459)..(459): n is a, c, t, g, unknown, or other
ctggagctccccgcggtggcggccgctctagaactagtggatcccccgggctgcaggaattcgcacgagaccattacctagaacatcctaatcgaaaactaaaattattattcatatatacggtatagtatcgactgttaccagtgcaatgggtcagtgctttcatcagctngagctnccttattgcatgcacgcaggttttggcccaacaacaagagcagaatgtatctgctggagaacacaggtgagaggatcttaacgttatgatttccatccatccgaccttgacaacgattcttcgtcgttatggtctgtctgatctttttttcctgtttttctttctcaacctgcaggggaatttgttcgtttcaacgagcttcaggagggggatttcatagtgatctactccgatgtcaagtcgggcaaatatgtatgttcttctattgccgactatttccntgctacataatgctcgtttttctgtccatatgcctgcatcattagtcaactcaaacgttgtgtcgtccctgaaactgcaatccaatctaccaaaccttttgcatgcaactgtttgaattgggaacccctgaatgaaaccaggaactaaggggctcttttgaaccccgtgtcagggaattggtttactccccagcactcttaaaaaccgtaaacccccttgggccctaatattccccccggaaaacg

SEQ ID NO: 36669 - DNA, 796 bp, Zea mays
  misc_feature: Ceres CLONE 1420844-F
  misc_feature (796)..(796): n is a, c, t, g, unknown, or other
tccccgcggtggcggccgctctagaactagtggatcccccgggctgcaggaattcgcacgagaccattacctagaacatcctaatcgaaaaattcgagaggcaccaactcagtctttctacgcccttccctcacgctccttcctctccaagaaaaagtaagcgtggagagcgtaaatctccgccgccgcgcaccgacgcccacggaacacgccgtcataggagtggagagagaaccccgcggcctcctcctccgtgaactccgcacaaggaggctagagcggcggcagacttctgagaggtcggttaaggagggctatgcgtgctccccgatggtggattctcggctcgctcaccgttccggtactctgcccaatccgatcggcggggcggccgccaagtactaacctccggtcagccaccaccctagatctatagggacgcgacatctagattccggcacaggacatagcctgcgtttcctggtacttagtatcgcgtaagccgactgtttgaagacggatgcagctgttactatcagcataacgtccccgctgaaggtgtaggtatatgctatatgctagcctccgcgataatgcaggcgccagtcggatctgagtagagagatcactgatctctacgcaagcaggtgagtaagcatgtggggcgcgcaagcggtatcctatgtcctgtactgtcctatgagagatgtatgccccctccgtctagacattgggtggacgagtatttcttgcgcatcatcctaatgaagccaaagagaagcagtgtagagataan

SEQ ID NO: 36670 - DNA, 646 bp, Zea mays
  misc_feature: Ceres CLONE 1420850-F
  misc_feature: Encodes the peptide sequence at SEQ ID NO. 36671
tggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtccctctcctcgcctggacgcgccgcctcctcgaatccttcctccctctgctcgaggagttccgcgccctgctcttcggctccggggactcgcccgctggtcggcccccgctcgaccgcctcgtcgccgactttctcgaaccgcgccgtcaggcgctcgacctctgcaacgccgtc

SEQ ID NO: 36671 - protein, 124 aa, Zea mays
  misc_feature: Ceres CLONE 1420850-F
MPATDSSSSSSSSPAAAPLSSIGRSIRSLRRDQNQIHSFPPPPDATDAFQRRAAQLLADLPAADDVPLLAWTRRLLESFLPLLEEFRALLFGSGDSPAGRPPLDRLVADFLEPRRQALDLCNAV

SEQ ID NO: 36672 - DNA, 648 bp, Zea mays
  misc_feature: Ceres CLONE 1420853-F
  misc_feature: Encodes the peptide sequence at SEQ ID NO. 36673
  misc_feature (452)..(452): n is a, c, t, g, unknown, or other
aaagctggagctccccgcggtggcggccgctctagaactagtggatcccccgggctgcaggaattcgcacgagaccattacctagaacatcctaatcgaaaaaggtagctgagcgaagcatccggtgtgttccctcgccatccgccgccgccgccatgccgggcttcgctcagcgtctcgcgggcatcccgtggcggagcatcgcgaggcaaggcctctcccgcgtgttcctggtggcgaaggcctactgcgtgatccacgtcgtcaacgaccacctctgctcggtgaccttagtgcggggcgccagcatgctgccgtccctgaacctggcgggcgacgcggtggcggtggacagggtcagcgtgaggctcggccgggtcgcgccgggggacatcgtgctgatgatctcccccgaggacccgcgcaagtcggtcgtcaagcgcgtcgtcggnatgcagggggactccgtcacctaccttgtcgacccccggcaaagcgactccctcagaaccgtcgtggtaccgcaagatcatgtctgggtgcagggtgacaatatctttgcttctaacgattccaggcatttggagctgtgcctttatggctgataacagggaagatcttttgccgggtttggccgcccggagagtt

SEQ ID NO: 36673 - protein, 149 aa, Zea mays
  misc_feature: Ceres CLONE 1420853-F
  misc_feature (46)..(125): Pfam Name: Peptidase_S24 Pfam Description: Peptidase S24-like
  misc_feature: SWISSPROT Homolog: EC 3.4.21.89 Signal peptidase I
MPGFAQRLAGIPWRSIARQGLSRVFLVAKAYCVIHVVNDHLCSVTLVRGASMLPSLNLAGDAVAVDRVSVRLGRVAPGDIVLMISPEDPRKSVVKRVVGMQGDSVTYLVDPRQSDSLRTVVVPQDHVWVQGDNIFASNDSRHLELCLYG

SEQ ID NO: 36674 - DNA, 716 bp, Zea mays
  misc_feature: Ceres CLONE 1420865-F
  misc_feature: Encodes the peptide sequence at SEQ ID NO. 36675
  misc_feature (491)..(491): n is a, c, t, g, unknown, or other
ctggagctccccgcggtggcggccgctctagaactagtggatcccccgggctgcaggaattcgcacgagaccattacctagaacatcctaatcgaaaaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggccggcagcaggctcaagggctccacgctccttacccgaagagtggtgacngatggatcagatgaatgggcaatctacggcgggaccggaaagtttgctatggcgagaggtgtcttcaaaaagaagtaccttgccgataggggatgcgcccggaacactgacgagctcagcatgcaggttttctgcccggggttttgctcatcacagcaacaaacaagcaggactccagcatctctgtcacaaaattgggttatgggtggcaaaggaggtcccccc

SEQ ID NO: 36675 - protein, 190 aa, Zea mays
  misc_feature: Ceres CLONE 1420865-F
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGSRLKGSTLLTRRVVTDGSDEWAIYGGTGKFAMARGVFKKKYLADRGCARNTDELSMQVFCPGFCSSQQQTSRTPASLSQNWVMGGKGGPP

SEQ ID NO: 36676 - DNA, 723 bp, Zea mays
  misc_feature: Ceres CLONE 1420866-F
  misc_feature: Encodes the peptide sequence at SEQ ID NO. 36677
  misc_feature (500)..(500): n is a, c, t, g, unknown, or other
  misc_feature (528)..(528): n is a, c, t, g, unknown, or other
aagctggagctccccgcggtggcggccgctctagaactagtggatcccccgggctgcaggaattcgcacgagaccattacctagaacatcctaatcgaaaaaggttaaagcgacgccgccgccgcaagccgtccgccttgcccttcacgaaggcttggtcctcctccttgtatctccactccccccttcacagatccgttcctccagctagggttagcgttcctctgcagcgatggcgatcaagcggactaaggcggagaagaagatcgcgtacgacaagaagctgtgcagcctgctcgatgagtacaccaaggtgctcatcgccctggccgacaacgtcggttccaagcagctccaggacatccgccggggcctcaggggcgactcggtggtgctcatggggaagaacacgctcatcaggcgttgcatcaaggtgtacgccgagaagaccggtaaccacacctttgacccgctcatggacctcctggtcggcaacgtangcctcatcttcaccaagggagacctcanggaggtgcgcgaggaagtcgccaagtacaagggtggggctcctgctcgtgttggtctggttgctccagttgatgttgttgtgccccctggcaacactgggctggatccgtcccagacctctttcttccagtgcttacatcccccaccagataaacagggtaccgtggaaaatatcacccctgtgagctgatcaga

SEQ ID NO: 36677 - protein, 161 aa, Zea mays
  misc_feature: Ceres CLONE 1420866-F
  misc_feature (6)..(110): Pfam Name: Ribosomal_L10 Pfam Description: Ribosomal protein L10
  misc_feature: SWISSPROT Homolog: EC 4.2.99.18 DNA-(apurinic or apyrimidinic site) lyase
  misc_feature (90)..(90): Xaa is any aa, unknown, or other
  misc_feature (99)..(99): Xaa is any aa, unknown, or other
MAIKRTKAEKKIAYDKKLCSLLDEYTKVLIALADNVGSKQLQDIRRGLRGDSVVLMGKNTLIRRCIKVYAEKTGNHTFDPLMDLLVGNVXLIFTKGDLXEVREEVAKYKGGAPARVGLVAPVDVVVPPGNTGLDPSQTSFFQCLHPPPDKQGTVENITPVS

SEQ ID NO: 36678 - DNA, 644 bp, Zea mays
  misc_feature: Ceres CLONE 1420874-F
  misc_feature: Encodes the peptide sequence at SEQ ID NO. 36679
  misc_feature (363)..(363): n is a, c, t, g, unknown, or other
  misc_feature (439)..(439): n is a, c, t, g, unknown, or other
ggagctccccgcggtggcggccgctctagaactagtggatcccccgggctgcaggaattcgcacgagaccattacctagaacatcctaatcgaaaaattgcgcacaccttgatgctgggcatgagcaggacggggttggccggagcggcgctgcgggtggcgctgacggcgctgctgccgctggtcctgccggcgtactacgtgtacaagctgaccacgtacctcctcggcgccgtcttccccgaggacgtcgccggcaaggtggtactcatcaccggcgcctcctccggcatcggcgagcacctggcctatgagtacgcgaagcggggagcctacctggcgctggtggcgaggaggggagcnagcctccccgaggtcggcgacgtcgcgctggggctgggctcgccgggcgtcctcgtcctcccggctgacgtctccnaggctcgggactgcgagggcttcatcgacgacacgattagctacttcggtagactggatcacctggtgaaacacgcgtccatctgggcagtgtgcaagttccgagagatccaggacgtcaggcacttgaaagccctgattgacatcaacttctgggggccacgtgtacccaacccgggttcgcattccctcactcagggagagcg

SEQ ID NO: 36679 - protein, 177 aa, Zea mays
  misc_feature: Ceres CLONE 1420874-F
  misc_feature (50)..(173): Pfam Name: adh_short Pfam Description: short chain dehydrogenase
  misc_feature: SWISSPROT Homolog: EC 1.1.1.146 11-beta-hydroxysteroid dehydrogenase
  misc_feature (110)..(110): Xaa is any aa, unknown, or other
MLGMSRTGLAGAALRVALTALLPLVLPAYYVYKLTTYLLGAVFPEDVAGKVVLITGASSGIGEHLAYEYAKRGAYLALVARRGASLPEVGDVALGLGSPGVLVLPADVSXARDCEGFIDDTISYFGRLDHLVKHASIWAVCKFREIQDVRHLKALIDINFWGPRVPNPGSHSLTQGE

SEQ ID NO: 36680 - DNA, 648 bp, Zea mays
  misc_feature: Ceres CLONE 1420877-F
  misc_feature: Encodes the peptide sequence at SEQ ID NO. 36681
aaagctggagctccccgcggtggcggccgctctataactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcggatgggtgatttgagcgtctgggttgtcagcggcgcgcccgaaggcagccggttggcggcggcgatggagctgcatcatcaggcgcagaaagaggctatggcgccgcagcaggctcaggctccgcccctcttcttggacttctcgcatggagggtagcagatcaaacaaagcgcactccttggctccccggcggatttcctccttcttgggaagcaagcccggcaccccttttgttccaatttccggatccgaaaaagggcccccggggaattaat

SEQ ID NO: 36681 - protein, 51 aa, Zea mays
  misc_feature: Ceres CLONE 1420877-F
MGDLSVWVVSGAPEGSRLAAAMELHHQAQKEAMAPQQAQAPPLFLDFSHGG

SEQ ID NO: 36682 - DNA, 648 bp, Zea mays
  misc_feature: Ceres CLONE 1420878-F
  misc_feature: Encodes the peptide sequence at SEQ ID NO. 36683
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaagaagtctatctttttctcctcctgccgtacgtccgttccagcttgcaaagcgctcgcgagctgctgccatggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccggcgcctctgggccgccgccgaggccgaggctggctaccgcgtgctcaccccgacgcccgcactctccatgggcccgcgaagcagcgcctcgctcgccgccgccatcgctaacatcggcgccgaagaggtggacgaagacgacctttcacgcaggtggggcggcgcttcgcccntcacgtccgggcccggttgacgcgtgggtcaccgcgctcagcgacacggcggcgtgc

SEQ ID NO: 36683 - protein, 146 aa, Zea mays
  misc_feature: Ceres CLONE 1420878-F
  misc_feature: SWISSPROT Homolog: EC 1.5.3.1 Sarcosine oxidase
  misc_feature (141)..(141): Xaa is any aa, unknown, or other
MAGAGAPAVPQAGRPAPNFDVIVVGAGIMGSCTAHAAASRGARVLLLERFDLLHPLGSSHGDSRIIRDAYAQPRYLRMVRLARRLWAAAEAEAGYRVLTPTPALSMGPRSSASLAAAIANIGAEEVDEDDLSRRWGGASPXTSGPG

SEQ ID NO: 36684 - DNA, 632 bp, Zea mays
  misc_feature: Ceres CLONE 1420887-F
  misc_feature: Encodes the peptide sequence at SEQ ID NO. 36685
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaaaccgccggtcaagtccctgatggacacgccgccgccctctctcccgccgtccaccctcctctggccggacctcctcgcgggcgcggcgtcctccacctgccgcctcgtcgccgcgcattcccgtcacttcctggccctatcctctctcctccttctcccgctcgccctcctcctactcgccctcccctgcccgttcttctctgcctccgcctcctccgccgcctcccctcccgtacatctccgggtcccgcaggatccgtcaaggtacccactacccatcccgctgccgctgctcgcccttgccgccgcgctcctctacctcgccgccttcgccgccgccgcggccagcgcgcacgcagggttcttcggtcgccccgtccggctcctcgcctcgctccgctccgtgccagcctcactcctccgcctcatcctgaccgccatcccggcctccccgctggcactccttccgctcctcccgctccccgcggcgctcggcgccgcactgcccgtcctcggcttcatccttttgn

SEQ ID NO: 36685 - protein, 170 aa, Zea mays
  misc_feature: Ceres CLONE 1420887-F
MDTPPPSLPPSTLLWPDLLAGAASSTCRLVAAHSRHFLALSSLLLLPLALLLLALPCPFFSASASSAASPPVHLRVPQDPSRYPLPIPLPLLALAAALLYLAAFAAAAASAHAGFFGRPVRLLASLRSVPASLLRLILTAIPASPLALLPLLPLPAALGAALPVLGFILL

SEQ ID NO: 36686 - DNA, 647 bp, Zea mays
  misc_feature: Ceres CLONE 1420888-F
ctggagctccccgcggtggcggccgctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccgtcctggatctgttgcgcgagagcgcggcatcccgcgagattcgcccccttctcttctcctaggagcaggaagcagcccaccgctcgctgagcgccgccgccgatgggcgtcgccggtgccatgaagctctgggaggtggagacccgccgcaagggccgcgccccggggccgacgacccctgcgcgtcctgtgac

SEQ ID NO: 36687 - DNA, 640 bp, Zea mays
  misc_feature: Ceres CLONE 1420891-F
  misc_feature: Encodes the peptide sequence at SEQ ID NO. 36688
aagctggagctccccgcggtggcggccgctctagaactagtggatcccccgggctgcaggaattcgcacgagaccattacctagaacatcctaatcgaaaaataggaatcatccatcgcgtctgtgctccccctcgcgcaatcctaccgcactcgcctcccgaaatcggccgccacggcgcctcacgccatggctcctgcccagcagctgcagctccctccgcctccggtggtctggcacgccgcctcctcgcccagatccgtccgtggtccgcccctccggcctcgcccagctccaaagctccctcctgctcgcgggcacgcgatctcgccctgggggccatgccctaggccgtcgtctcggctcgcgtccacctcgtccagcgtcacaagtggcgccgccgccggtgtcggctacttcgatctcccgcccgccgtcgactcgtccagcagtacctacgctctgaatccgatcccctcgccggtggcgacggcgtcggctgaccccatccccaaactcgggcgcggggaaccccaagcggaaaaacaaaattggcccgggggtccccccaataaactttaaacgaaagggacacccaagggaaactttaaatcaaaaaacaaccccgaccctccccgga

SEQ ID NO: 36688 - protein, 130 aa, Zea mays
  misc_feature: Ceres CLONE 1420891-F
MAPAQQLQLPPPPVVWHAASSPRSVRGPPLRPRPAPKLPPARGHAISPWGPCPRPSSRLASTSSSVTSGAAAGVGYFDLPPAVDSSSSTYALNPIPSPVATASADPIPKLGRGEPQAEKQNWPGGPPNKL

SEQ ID NO: 36689 - DNA, 643 bp, Zea mays
  misc_feature: Ceres CLONE 1420893-F
  misc_feature: Encodes the peptide sequence at SEQ ID NO. 36690
  misc_feature (463)..(463): n is a, c, t, g, unknown, or other
tggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacgggtggcttcttctggctggtgaaccacggagtgccngaagagctgatgggcggcatgctccgcgggggtgcgccagttcaacgaaggccccgtggaagcgaagcaggcgctctactcgagggacctcgctcgcaacctgcgcttcggcttcaacttccacctcctcaaagctgctgccgccgactggcgcgacacgctcttctgcgaagtggctcc

SEQ ID NO: 36690 - protein, 167 aa, Zea mays
  misc_feature: Ceres CLONE 1420893-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTGGFFWLVNHGVPEELMGGMLRGGAPVQRRPRGSEAGALLEGPRSQPALRLQLPPPQSCCRRLARHALLRSGS

SEQ ID NO: 36691 - DNA, 639 bp, Zea mays
  misc_feature: Ceres CLONE 1420899-F
  misc_feature: Encodes the peptide sequence at SEQ ID NO. 36692
ggcggccgctctagaactagtggatcccccgggctgcaggaattcgcacgagaccattacctagaacatcctaatcgaaaaacagtgcctctcgctcactgactgactgtaataccagagatcgaacaacttggtcctgcagctcaagaagagagtttttgtgcatttgggggccgggggcaagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcaccgccatcacggaggccgacctaaacaagattgagccatgggacctccctagcaaggcgaagatgggcgagaaagagtggtacttcttctaccagaaggaccgcaagtacccgacggggctgagggcgaaccgggccaccgaggccggttactggaaggcgacgggcaaggacaaggaggtctacaacgcccgcggaaggggtggcggtactggtcagcatgaagaagacgctcgtcttctacagggggaggggctcccaggggggacaaggacagactaaa

SEQ ID NO: 36692 - protein, 145 aa, Zea mays
  misc_feature: Ceres CLONE 1420899-F
  misc_feature (23)..(146): Pfam Name: NAM Pfam Description: No apical meristem (NAM) protein
MAADQQPQLQEEMNDAAGGGLRLPPGFRFHPSDFEIVSFYLTNKVLNTRFTCTAITEADLNKIEPWDLPSKAKMGEKEWYFFYQKDRKYPTGLRANRATEAGYWKATGKDKEVYNARGRGGGTGQHEEDARLLQGEGLPGGTRTD

SEQ ID NO: 36693 - DNA, 650 bp, Zea mays
  misc_feature: Ceres CLONE 1420902-F
  misc_feature: Encodes the peptide sequence at SEQ ID NO. 36694
ggagctccccgcggtggcggccgctctagaactagtggatcccccgggctgcaggaattcgcacgagaccattacctagaacatcctaatcgaaaaaatcacgaatcaccaacaccctctcctccaccttccatcccgatcaccgccgccaccgctttcgttccacgtcccgatggcaccggtagatctaacccccaggcagccccggaaggcgtatggcggcgacgccggcgcctactacgagtggagcccagccgacctgcccatgctcggcgtcgcctccatcggcgcagccaagctctccctcgccgccggtgggctctcgctccccagctactccgactcttccaaggtcgcgtacgttcttgaaggcactggcacctgcggcatcgtcctgccggaggcgaccaaagagaaggtgctggccgtgaaggagggcgacgccctcgcgctccccttcggcgtggtcacgtggtggcacaacggccccgccgcggcgacccagctcacggtcctcctcctcgggcacacctccaaaggccacaggcccgggccagttcaccaactttcaactgacgggcgcgagcggcatcttcacggccttctcaccgaattcttggcccccgccgtgggaaccggccgaaagcaaa

SEQ ID NO: 36694 - protein, 159 aa, Zea mays
  misc_feature: Ceres CLONE 1420902-F
  misc_feature (6)..(142): Pfam Name: Cupin_1 Pfam Description: Cupin
MAPVDLTPRQPRKAYGGDAGAYYEWSPADLPMLGVASIGAAKLSLAAGGLSLPSYSDSSKVAYVLEGTGTCGIVLPEATKEKVLAVKEGDALALPFGVVTWWHNGPAAATQLTVLLLGHTSKGHRPGPVHQLSTDGRERHLHGLLTEFLAPAVGTGRKQ

SEQ ID NO: 36695 - DNA, 659 bp, Zea mays
  misc_feature: Ceres CLONE 1420903-F
  misc_feature: Encodes the peptide sequence at SEQ ID NO. 36696
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccg

SEQ ID NO: 36696 - protein, 108 aa, Zea mays; identical to SEQ ID NO: 16131
  misc_feature: Ceres CLONE 1420903-F

SEQ ID NO: 36697 - DNA, 643 bp, Zea mays
  misc_feature: Ceres CLONE 1420906-F
  misc_feature: Encodes the peptide sequence at SEQ ID NO. 36698
  misc_feature (407)..(407): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
aaactggagctccccgcggtggcggccgctctagaactagtggatcccccgggctgcaggaattcgcacgagaccattacctagaacatcctaatcgaaaaaaaatcacaaagccagcccatcacctcagtcctcacactgacatttcactctcggctgctggagtgtcggccgctgccatctgcctgccgctcactcccacgcgccgcaatgtgccactccccactcggcgccgccaccaccaccgcgggggcgctagcgctcctcttcctcctgccgctagcctcggccgccgccgccggcggcggcaccgcggcgaaggcgacgcccaacatcacggcgctcatgtccaagggcgggtgcaaggcgttcgcgtcgctgctggacaagtcccccgacgctctgtncgcgtcgagtccgcgtgagacgcgcgtgataccnnnnttctgcccgaacgacgaagccgtgcgcggggtcatgcccagctaccggaacctgagcgcggacggcaaagcgtccctgctgctgtcccacgcggggcccgtgtactacaccctgcggggccctgaattcaagaaccggcccatgaaaccctttggcaaccaagggcccccccaggaatttaaacttgaagggtgaaaaa

SEQ ID NO: 36698 - protein, 142 aa, Zea mays
  misc_feature: Ceres CLONE 1420906-F
  misc_feature (66)..(66): Xaa is any aa, unknown, or other
  misc_feature (78)..(78): Xaa is any aa, unknown, or other
MCHSPLGAATTTAGALALLFLLPLASAAAAGGGTAAKATPNITALMSKGGCKAFASLLDKSPDALXASSPRETRVIPXFCPNDEAVRGVMPSYRNLSADGKASLLLSHAGPVYYTLRGPEFKNRPMKPFGNQGPPQEFKLEG

SEQ ID NO: 36699 - DNA, 665 bp, Zea mays
  misc_feature: Ceres CLONE 1420912-F
  misc_feature: Encodes the peptide sequence at SEQ ID NO. 36700
  misc_feature (506)..(506): n is a, c, t, g, unknown, or other
agctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcangaaacctgcggcgttggcagcacccccgatcctgggccagtgcgtcgagtttcctgaggcatcaatgcaaccccgacggggaatgccctaatggttcccccccaaaggcaaaactttttgtgcggacaaaaatgtgtcccccccccccccggagggggg

SEQ ID NO: 36700 - protein, 67 aa, Zea mays
  misc_feature: Ceres CLONE 1420912-F
  misc_feature (15)..(15): Xaa is any aa, unknown, or other
MPVPTAASKPVPAAXNLRRWQHPRSWASASSFLRHQCNPDGECPNGSPPKAKLFVRTKMCPPPPRRG

SEQ ID NO: 36701 - DNA, 710 bp, Zea mays
  misc_feature: Ceres CLONE 1420917-F
  misc_feature: Encodes the peptide sequence at SEQ ID NO. 36702
  misc_feature (710)..(710): n is a, c, t, g, unknown, or other
ctccccgcggtggcggccgctctagaactagtggatcccccgggctgcaggaattcgcacgagaccattacctagaacatcctaatcgaaaaacctttctttccctcttccgtcttccccaacccaaccacccgcaccaagccgacccagagagaggagagcctgcttgcctgcctgggctggactcccccttcgcctcctcctcgtccgatcggccccgccccgcctagctgctgctgctgctgctgctgctgctgcgcgcgcgccgcggcgggacccgggaggagcgccggtggtggtggccgggcccgatggagtgggcgtcggcggcgtacacggctgcggcgctggtgtgcgccgcggcggcgagcgtggtcgcgctcgcgcacatctaccgccacctcctccactacgccgagcccatctaccagcggttcatcgtccgcatcatattcatggtcccggtatatgctgtgatgtcattcctttcccttatcctccctgacaacgcgatatattttaattctattcgagagatatatgatgcttgggtcatctacaattttctctcactctgcttggcatgggtgggaggtcctggtgctgtggtggtaagcttgagtggccgaaccctgaaaccgtcgtggattctgatgactttgctgtatccagctattcctctagatgggcgttttatacgaagatgcaan

SEQ ID NO: 36702 - protein, 132 aa, Zea mays
  misc_feature: Ceres CLONE 1420917-F
  misc_feature (5)..(133): Pfam Name: DUF300 Pfam Description: Domain of unknown function
MEWASAAYTAAALVCAAAASVVALAHIYRHLLHYAEPIYQRFIVRIIFMVPVYAVMSFLSLILPDNAIYFNSIREIYDAWVIYNFLSLCLAWVGGPGAVVVSLSGRTLKPSWILMTLLYPAIPLDGRFIRRC

SEQ ID NO: 36703 - DNA, 816 bp, Zea mays
  misc_feature: Ceres CLONE 1420924-F
  misc_feature: Encodes the peptide sequence at SEQ ID NO. 36704
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
nnnnccgcccccccccccccgggagggcgcaccagnnttaannnnnncccaaannnnacaaagctggagctccaccgcggtggcggccgctctagaactagtggatcccccgggctgcaggaattcgcacgagaccattacctagaacatcctaatcgaaaaatctcccataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccaggattccacagttcctcccaccagttacttcaatgggcatcgaacatcccgccgtgcaagcctacaggctacaactagcggcttgcgagcgatgctccttacaacaaccgagtgggcggaattgggaacaacgattcccttgggtgactactaacccccagcaaactgaattgcggaggcgaacaaccaatcaagaaccagtttttccagcccgtccactgagggctcacccaaagccgggggggggcaaagcgctgataaaacgggccattaccaacaacgggggccaagttagacgtccgaagccgccgcttggcgggtgggacaaaacgggaggcagggggaggcccaaacaagcgtacaccaagagtcggggagaaacagtgtgtagggggcgagggcgggggcggggacaaagaaaaagggcgcgagaggagaatcgccgcgcggtccacgggagaagcccgcgcgccaagacgacgcgcg

SEQ ID NO: 36704 - protein, 195 aa, Zea mays
  misc_feature: Ceres CLONE 1420924-F
  misc_feature (1)..(193): Pfam Name: Zein Pfam Description: Zein seed storage protein
MATKILALLALLALLVSATNAFIIPQCSLAPSARIPQFLPPVTSMGIEHPAVQAYRLQLAACERCSLQQPSGRNWEQRFPWVTTNPQQTELRRRTTNQEPVFPARPLRAHPKPGGGKALIKRAITNNGGQVRRPKPPLGGWDKTGGRGRPKQAYTKSRGETVCRGRGRGRGQRKRAREENRRAVHGRSPRAKTTR

SEQ ID NO: 36705 - DNA, 656 bp, Zea mays
  misc_feature: Ceres CLONE 1420927-F
  misc_feature: Encodes the peptide sequence at SEQ ID NO. 36706
aaagctggagctccccgcggtggcggccgctctagaactagtggatcccccgggctgcaggaattcgcacgagaccattacctagaacatcctaatcgaaaaatcgagttggattgggttcaaagttgggcttttggacagctgtggtgtgcacggcagctctgtgacttgtgaggaggaagggaggaagaaagcggatccatggcgtcgaagcggatcctcaaggagctcaaggacctgcagaaggatcctcccacctcttgcagcgcaggccctgttgccgaagatatgttctactggcaggcgacgattatggggccatcagatagcccatacgctggtggcgtatttttggtcactattcactttccaccggactacccattcaaaccaccgaaggttgcattcaagacgaaggtttaccaccccgatatcaacagcaacgggagcatctgtcttgatatcttgaaggagccatggagccctgcactgacagtttctaagggcctccctctcatttggtcccttctgaccgaccccaaccctgacgatccggtggggccaagagattggtcacttggtacaagactggtcgcgtgaaggacgaatccactgcgtgggactgggctccgaaattttgccatgggcctgaccag

SEQ ID NO: 36706 - protein, 132 aa, Zea mays
  misc_feature: Ceres CLONE 1420927-F
  misc_feature (5)..(131): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPVAEDMFYWQATIMGPSDSPYAGGVFLVTIHFPPDYPFKPPKVAFKTKVYHPDINSNGSICLDILKEPWSPALTVSKGLPLIWSLLTDPNPDDPVGPRDWSLGTRLVA

SEQ ID NO: 36707 - DNA, 654 bp, Zea mays
  misc_feature: Ceres CLONE 1420928-F
  misc_feature (394)..(394): n is a, c, t, g, unknown, or other
  misc_feature (398)..(398): n is a, c, t, g, unknown, or other
aagctggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacgggtctcnttcntgttcgggggaggaggccggtggtggtgtaccaaagcagcgccaaccctctgcccagcggcatccccgcctaccacgtgcagatcatcaccgtctgcgggcgagggtgcaccgtgtacgacgtgcacgtctcctgcggggactttcgctccccgaagctcgtccaacccggcaaagttccagggggtcccctttcaacgattgcttcgtcaaggggcggcgccgccttggaaaaccaccgagaccgtctccttccc

SEQ ID NO: 36708 - DNA, 664 bp, Zea mays
  misc_feature: Ceres CLONE 1420930-F
  misc_feature: Encodes the peptide sequence at SEQ ID NO. 36709
  misc_feature (364)..(364): n is a, c, t, g, unknown, or other
aaaactggagctccccgcggtggcggccgctctagaactagtggatcccccgggctgcaggaattcgcacgagaccattacctagaacatcctaatcgaaaactctctgttgcatttcccgtcctgtccttccacccggcggcttaaaccctagttctcactcccatcgccgcttcagctccgccgctgcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctngttgacaagaaacccacacataacaattttgatctgagatttcccgaaaaaaagttgagcttgcccacacctccaaaactaccacgtttttttccctgggttaaaggggtagaaccccctttccgaaaaaaaaaaaaggaatctttgatttctaaaaaaaaaaaaccaagagattttatatttcccctttttccgggaaaagggcaaacccttttaaaaaaaaacaacaaaaatttccccaaaagaggggggttgtggcccccctccacaaaaaaaagcgcgcggcgcttatcaaaaaag

SEQ ID NO: 36709 - protein, 57 aa, Zea mays
  misc_feature: Ceres CLONE 1420930-F
MEFWGLEVKPGSTVKCEPGYGFVLHLSQAALGESKKSDNALMYVKIDDQKLAIGTLS

SEQ ID NO: 36710 - DNA, 656 bp, Zea mays
  misc_feature: Ceres CLONE 1420939-F
  misc_feature: Encodes the peptide sequence at SEQ ID NO. 36711
tccccgcggtggcggccgctctagaactagtggatcccccgggctgcaggaattcgcacgagaccattacctagaacatcctaatcgaaaaagttctactccccgctccccattcacgcactctcactctacctccctccctccctcgccggcgccgcgcgtgctcccgcgggatgctgcgtgcggcgcggtacctgctggggtcgccgggcgcgagcgggttcgggtccaggtcgacggcggaggaggtgaccccggacctgggcgcgacgacggccatcatcacgggcgccacgtccgggatcggcgccgagacggcgcgcgtgctggcgaagcgcggcgcgcgcgtggtgatcccggcgcggagcgccaaggcggcggaggacgtgcgcgcgcgcatcgtggccgagtgccccgccgccgccgtcctcgtgctcccgctcgacctcagctcgctcgcgtccgtgcgcgccttcgccgacaggttcctagcgctcggcctcccgctccacctcctcatgtacgtacgttcgtcgatcggggcgccgccaccgccgccctcgtccaagtccacagtacatgtatgtatgcgtatgtgtgtgatgcctgtgcgcgcgcgcgtgcagaaacaacgccggcaagttctcgcacgggca

SEQ ID NO: 36711 - protein, 161 aa, Zea mays
  misc_feature: Ceres CLONE 1420939-F
  misc_feature (33)..(158): Pfam Name: adh_short Pfam Description: short chain dehydrogenase
MLRAARYLLGSPGASGFGSRSTAEEVTPDLGATTAIITGATSGIGAETARVLAKRGARVVIPARSAKAAEDVRARIVAECPAAAVLVLPLDLSSLASVRAFADRFLALGLPLHLLMYVRSSIGAPPPPPSSKSTVHVCMRMCVMPVRARVQKQRRQVLARA

SEQ ID NO: 36712 - DNA, 645 bp, Zea mays
  misc_feature: Ceres CLONE 1420943-F
  misc_feature: Encodes the peptide sequence at SEQ ID NO. 36713
aaaactggagctccccgcggtggcggccgctctagaactagtggatcccccgggctgcaggaattcgcacgagaccattacctagaacatcctaatcgaaaagacaccccctccgctctccttatcccttccattcgcccaaacccccgccgccgtgacccctgccagcccgcggccttcccctcgttctaggcttcaactgccggcctcgtgtcttctgggcaagtgaagagagagatggcgtcgccaataccgcgcgagtgggtcgggctgcagcagtttcctccggccacccagaccgagctgcacgagctcctcggcaagctcaaggaggaggatgtgagcacattgacaattctggtgatggggaaaggcggagtggggaagtcatctactgtttactccatcgtcggggagaggacgccactgtcagcgctttccagtctgagggtctgagacccatgaatgtgtcccgcacaaaggcaagtttcaccttaacattatcgaccctcctggggctatttgaagggggatacattaatgaagcaggttgtgaaatccttaaaaaaattcttcctgggcaaaaacatatgaagttccccctgaaaggggaccctttggaaggctaacaaaaggaaacccctt

SEQ ID NO: 36713 - protein, 72 aa, Zea mays
  misc_feature: Ceres CLONE 1420943-F
MASPIPREWVGLQQFPPATQTELHELLGKLKEEDVSTLTILVMGKGGVGKSSTVYSIVGERTPLSALSSLRV

SEQ ID NO: 36714 - DNA, 706 bp, Zea mays
  misc_feature: Ceres CLONE 1420956-F
  misc_feature: Encodes the peptide sequence at SEQ ID NO. 36715
  misc_feature (697)..(697): n is a, c, t, g, unknown, or other
aagctggagctccccgcggtggcggccgctctagaactagtggatcccccgggctgcaggaattcgcacgagaccattacctagaacatcctaatcgaaaaaaccgcagcagggcgttgggcgagtgagtgagtcagtgaggctgggatagcagcagcagcatcagtgcgccgcactcaacttctcttcttgccgtgcggtgcggcgcggcgcggggaggcaccgcacggccgcaagcaatgccgcgccggcagaggacgcgcagcagcgaggagctcaaggcggaggacttcgtcgactcggtgctcaacttcggcggcaggaaggaggatggggaagaggagaagcaggaggccggcggggacggccagccggcggcggagttcaagtccaagaacctggaggccgagcggaagcggcgcggcaagctcaaccgcaacatcctcgcgctcagggccgtggtgccgaacatcaccaagatgagcaaggagtccaccctctcggacgctatcgacctcatcaagaagctccagaaccaggtccttgagctgcagcgccagctcgccgactcgcccggagaggcctgggagaagcagggcagcgcgtcgtgctctgaatccttcactgccacggaaaacatgccgtatcagggtcagatcgagctggttcctctggggccatgcaagtaccacctcangatcttctg

SEQ ID NO: 36715 - protein, 155 aa, Zea mays
  misc_feature: Ceres CLONE 1420956-F
  misc_feature (51)..(98): Pfam Name: HLH Pfam Description: Helix-loop-helix DNA-binding domain
  misc_feature (153)..(153): Xaa is any aa, unknown, or other
MPRRQRTRSSEELKAEDFVDSVLNFGGRKEDGEEEKQEAGGDGQPAAEFKSKNLEAERKRRGKLNRNILALRAVVPNITKMSKESTLSDAIDLIKKLQNQVLELQRQLADSPGEAWEKQGSASCSESFTATENMPYQGQIELVPLGPCKYHLXIF

SEQ ID NO: 36716 - DNA, 557 bp, Zea mays
  misc_feature: Ceres CLONE 1420959-F
  misc_feature: Encodes the peptide sequence at SEQ ID NO. 36717
aaagctggagctccccgcggtggcggccgctctagaactagtggatcccccgggctgcaggaattcgcacgagaccattacctagaacatcctaatctaaaagacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatggcctccacgtgaatcaggtgctccagtggcttaaaaggtaggggaagaaaatgggaacctgcttccaaaactccaggagggaaaagtttaaccccccaatcctggggttggggggggccatcccccctcaacttaaaacaaaaaggtttaaaaaccctttacaaaaaaaagggccccccccaaaagagaatgggtgtttttaaaaccacgggaaa

SEQ ID NO: 36717 - protein, 41 aa, Zea mays
  misc_feature: Ceres CLONE 1420959-F
MSDSHETDRNIEIWKIKKLIKALESARGNGTSMISLIMAST

SEQ ID NO: 36718 - DNA, 649 bp, Zea mays
  misc_feature: Ceres CLONE 1420962-F
  misc_feature: Encodes the peptide sequence at SEQ ID NO. 36719
aagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcacccattgatgatgccgagcatgatgtcaccaatggtcttgccgagcatgatgtcgcaaatgatgatgcccacaatgttactgcgacccccgtcctccaagattatgctgcaaccgcagttaccatttcatgttcaacccaatggcccttgacgattccaccccatgttcttaacagcaacccctttggtgggggctgcctttctaaataaaaaaattttgggttttacca

SEQ ID NO: 36719 - protein, 155 aa, Zea mays
  misc_feature: Ceres CLONE 1420962-F
MAAKMLALFALLALCASATSATHIPGHLPPVMPLGTMNPCMQYCMMQQGLASLMACPSLMLQQLLALPLQTMPVMMPQMMTPNMMSPIDDAEHDVTNGLAEHDVANDDAHNVTATPVLQDYAATAVTISCSTQWPLTIPPHVLNSNPFGGGCLSK

SEQ ID NO: 36720 - DNA, 678 bp, Zea mays
  misc_feature: Ceres CLONE 1420969-F
  misc_feature: Encodes the peptide sequence at SEQ ID NO. 36721
  misc_feature (678)..(678): n is a, c, t, g, unknown, or other
ctccccgcggtggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtggcagctggtgctaatcctgttcagn

SEQ ID NO: 36721 - protein, 149 aa, Zea mays
  misc_feature: Ceres CLONE 1420969-F
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQ

SEQ ID NO: 36722 - DNA, 764 bp, Zea mays
  misc_feature: Ceres CLONE 1420979-F
  misc_feature: Encodes the peptide sequence at SEQ ID NO. 36723
  misc_feature (12)..(12): n is a, c, t, g, unknown, or other
  misc_feature (22)..(22): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gggttttggccncccccccccnccaggngnnnnaggnnggggggggnggnnnctaatactggcgctccccgcggtggcggccgctctatactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaagtcgactccagcatccctcgtccccgcatcaccgcgccgccgacactccgctcgctttcgctcccgagacccgggcctgccgagccgccgccatggacgaggagtacgacgtgatcgttctgggcacggggctcagggagtgcatcctcagcggtctcctctctgtcgacggcctcaaggttctacacatggatagaaatgattactacggaggagattccacctccctaaacctgaacccgctcctggaagaggtttaggggggaagacaagccaccggcacatctaggtgcaagccgagattacaatgtagaccatgggtcccaagtttatgatggccaacgggactttgggtcgcacccctctttcacactgggtgggggaaagaatttgggcattccaaaggctgttggaggggagcccccgagtttggtcgaagcgggagaacttctaaaagggtttcctggccggcgggagcagggagggcttctaaaaatcccgccattgggatgggcgcccacttgcgacg

SEQ ID NO: 36723 - protein, 55 aa, Zea mays
  misc_feature: Ceres CLONE 1420979-F
MDEEYDVIVLGTGLRECILSGLLSVDGLKVLHMDRNDYYGGDSTSLNLNPLLEEV

SEQ ID NO: 36724 - DNA, 520 bp, Zea mays
  misc_feature: Ceres CLONE 1420993-F
  misc_feature (268)..(268): n is a, c, t, g, unknown, or other
cagagctggagctccccgcggtggcggccgctctagaactagtggatcccccgggctgcaggaattcgcacgagaccattacctagaacatcctaatcgaaaaatctcgtcgctcggctcccgaccgcatcgcgatcagtcatctcctgcgtctcgttctcgccggagatcagacgcgccaccgccgggcgatggatgcctcctaccgccgcgccggtgccggaagcggttctgctccccgctcccgtcgaggacatctacaagggantaacgggggccggggggtcggcgtctcgggcctacccagagtcaagattcacccgtggcgacccaaaaggaaactgggcttacgggcccaacaaacggggaggggcctccccgggaaggggccccgaattccgaaactgccctggaaaattccccggcagggaaaacccccaggggggcccttcccccccccccacacgggggaatatgcgggattttaaaaccccgggggtaaaaaaaaagagtcctccca

SEQ ID NO: 36725 - DNA, 577 bp, Zea mays
  misc_feature: Ceres CLONE 1420998-F
  misc_feature (225)..(225): n is a, c, t, g, unknown, or other
  misc_feature (230)..(230): n is a, c, t, g, unknown, or other
gctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcacttttcagtctccgagactccgagtctcggtcgcaccccgtcccctgcagcctgtgctctgggtttgaagggagtgancttcnaggaacccggaaggggccaggaaatgaagccaaatccgccaagaaaaaattgccatggttgggcctggttttccctggggggcccgttccccccgggcttggggggttccggggggggaaggcccccttcccccaagggggacttttaaacacccccccggggggggttttttaaaaaaacctttttttttttttgagggggggccctccccaatcccccggtgggggaaaaaaacgccgccggggggaaattttttttttcgggggccacccccccggggggggggtattcctttttttttttccccgggggggcgctcccctcctaagggggtgggggggggggg

SEQ ID NO: 36726 - DNA, 646 bp, Zea mays
  misc_feature: Ceres CLONE 1421000-F
  misc_feature: Encodes the peptide sequence at SEQ ID NO. 36727
  misc_feature (356)..(356): n is a, c, t, g, unknown, or other
  misc_feature (378)..(378): n is a, c, t, g, unknown, or other
tggagctccaccgcggtggcggccgctctagaactagtggatcccccgggctgcaggaattcgcacgagaccattacctagaacatcctaatcgaaaaattctgcagcgccagctcgctcctcgccccgcccccttctctcagcggcgacgcctcgggcgttcctaccctgccccctctccggacccccacgccgtcgggcgaaagcagccgggcaagagcccgatccagaccccgcgagctccacctgagagatacgggctcgccgcgatggaattcgagtcagcggcgcggcggcggcagcgcaaactctcttcgccgtcgttgaggacccactcacgcctgcttttgacgccntggccggtggggaagggcggcntgtctggggtactcttcatcgtcgtcttccagcggtctcgaactcggggtcgagccctttttcctccggaaccggccgttccgggttttccccccccccctcgaaacctggaaagggccgggtcctcctttaactccccccaaattccgggccccccccaaaaaaaggggggggttaccctggaaaaccgaaaaaaatggggttaagggggccccttgggctaaaccccccttggggtccccaaaatttgggggggggggcgcgggtt

SEQ ID NO: 36727 - protein, 104 aa, Zea mays
  misc_feature: Ceres CLONE 1421000-F
  misc_feature (37)..(37): Xaa is any aa, unknown, or other
MEFESAARRRQRKLSSPSLRTHSRLLLTPWPVGKGGXSGVLFIVVFQRSRTRGRALFPPEPAVPGFPPPPRNLERAGSSFNSPQIPGPPQKKGGVTLENRKKWG

SEQ ID NO: 36728 - DNA, 665 bp, Zea mays
  misc_feature: Ceres CLONE 1421017-F
  misc_feature: Encodes the peptide sequence at SEQ ID NO. 36729
ctggagctccccgcggtggcggccgctctagaactagtggatcccccgggctgcaggaattcgcacgagaccattacctagaacatcctaatcgaaaactgtgtcttgtccagtccgggtctccagggctccggcaccggcaggcagagagctaccaaaccccaccaccacgaacggccgccgccgacgagacgggggcgcatggcgactgcatcctccttcaccgccatcttcttcagcagcgccttcgcggcctgcttcgcggagccaaagtgcggctccagctgcaaaggaaggcaccactaccgtcgccaccagtggctgcagcagctgctgctggaggcacgctagccacaatcatgtgcatcgccagggaggaaggggttgccgcgctctggaagggcgtcatccccggcctccaccgtcagttcctctatggcggcctccgcatcggcttgtatgagcctgtgaaggctttcttcgtcggaggcgctgttgtgggtgatgtcagtttactaagcaagatccttgctgcacttaccacaggtgtgatagcgattgttgtggcaaatccaactgatcttgtcaaagttaggttgcaagctgatggaaaagctaacactatcaagaggagttattctggagcccttaatgcatacgctaca

SEQ ID NO: 36729 - protein, 221 aa, Zea mays
  misc_feature: Ceres CLONE 1421017-F
  misc_feature (84)..(164): Pfam Name: Mito_carr Pfam Description: Mitochondrial carrier protein
GAPRGGGRSRTSGSPGLQEFARDHYLEHPNRKLCLVQSGSPGLRHRQAESYQTPPPRTAAADETGAHGDCILLHRHLLQQRLRGLLRGAKVRLQLQRKAPLPSPPVAAAAAAGGTLATIMCIAREEGVAALWKGVIPGLHRQFLYGGLRIGLYEPVKAFFVGGAVVGDVSLLSKILAALTTGVIAIVVANPTDLVKVRLQADGKANTIKRSYSGALNAYAT

SEQ ID NO: 36730 - DNA, 671 bp, Zea mays
  misc_feature: Ceres CLONE 1421018-F
  misc_feature: Translation starting site: 230
  misc_feature: Pfam Name: DUF298 Pfam Description: Domain of unknown function (DUF298)
ctccccgcggtggcggccgctctagaactagtggatcccccgggctgcaggaattcgcacgagaccattacctagaacatcctaatcgaaaagaggcccccgacagcgaactcgggactcgccaaccgagaaggaagaactagtcgcgaggtgaagaggagaacctgaggtggtcccgaatcagagacggaagaaggtgggttcaggagcaagccagcctgccgccgccatgaggcgcacctcgaagaaatcgtcgtcgtctacggcgaccgccagcgctggccctactaaagcagtttccaaggaagtagaacggattgatcaatttttctatacttacgctgataactcatctggcatgattgacccagaaggcattgaaacactctgttctcaccttgaagttccccacactgatgttaggattctaatgttagcatggaaaaatgggctgtgataagcaaggtttattttaccttggatgaatggagaactggcttgaaagctcttcgagctgacagtattagtaaactgaagaaagcatttccagaactggtcaagaggttacaagccatcccatttccaggatttctcatatatgcatttcgttattgcctcacagaggataagaagaaatgtttagattaccagttgcttgtgaggtgcttgat

SEQ ID NO: 36731 - DNA, 652 bp, Zea mays
  misc_feature: Ceres CLONE 1421019-F
  misc_feature: Encodes the peptide sequence at SEQ ID NO. 36732
aaagctggagctccccgcggtggcggccgctctagaactagtggatcccccgggctgcaggaattcgcacgagaccattacctagaacatcctaatcgaaaaagatcagatcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgcttctcatggccaacgccggggccaacaccaacggctcccagttcttcatctgcaccgtcgcgaccccttggctcgacggcaagcacgtcgtcttcggccaagtcgtcgagggcatggacgtcgtcaaaggcatcgaaaaagtgggcaccccaacggctccccctccaagggggcag

SEQ ID NO: 36732 - protein, 163 aa, Zea mays
  misc_feature: Ceres CLONE 1421019-F
  misc_feature (5)..(157): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLHYKGSTFHRVIPEFMCQGGDFTRGNGTGGESIYGEKFPDEKFVRKHTAPGVLLMANAGANTNGSQFFICTVATPWLDGKHVVFGQVVEGMDVVKGIEKVGTPTAPPPRGQ

SEQ ID NO: 36733 - DNA, 671 bp, Zea mays
  misc_feature: Ceres CLONE 1421027-F
  misc_feature: Translation starting site: 195
  misc_feature (569)..(569): n is a, c, t, g, unknown, or other
  misc_feature (637)..(637): n is a, c, t, g, unknown, or other
  misc_feature (643)..(643): n is a, c, t, g, unknown, or other
tccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgccgtggacgcnggcgggcaggggaggaaaagctgctggtggtggtcggcggctgggacccggagacgtgggcgccgacngacgcngtgctcgtctacgacttcctgtcggggc

SEQ ID NO: 36734 - DNA, 653 bp, Zea mays
  misc_feature: Ceres CLONE 1421031-F
  misc_feature: Translation starting site: 308
  misc_feature: Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
  misc_feature (22)..(22): n is a, c, t, g, unknown, or other
  misc_feature (469)..(469): n is a, c, t, g, unknown, or other
caaagctgggagctccaccgtncggtggcggccgctctagaactagtggatcccccgggctgcaggaattcgcacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaagccaccacgcccttcgacggccagaagcctggcacctccggcctccgcaagaaggttactgtattccagcagcctcattatctgcagaactttgtccaatcaacattcaatgccctttctgtggatcaagtagaangtgcacaattgttgtctctggtgatggccgctatttctcaaaagatgcttgtcagatcataacaaaaatgctgctgccaatggataagaactggtttgggttgaacaaaaaagtcccaaggcacccccgccggaactgccggccacccgaaaaaaattgggcaaatggatcaaaggctatgggt

SEQ ID NO: 36735 - DNA, 641 bp, Zea mays
  misc_feature: Ceres CLONE 1421032-F
  misc_feature: Encodes the peptide sequence at SEQ ID NO. 36736
tggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaagtgggagacgcaccactacgtctcccggctcaaccaggacttccctccagtggcgccgtctattacttcggccaaagccgacgcgcgtctcatcggcgtgtgagtccttccggtcgaggaaaatttttcaattccctgcccggcggaagaaccaaccgcctttgggaccctcccccccccccaaaaatcaaaccaaggcctggggaacaaaccccccaccttggcggggtcttcttggaaaagggggaacttggcccccctgtgcccccccccttttcgga

SEQ ID NO: 36736 - protein, 163 aa, Zea mays
  misc_feature: Ceres CLONE 1421032-F
  misc_feature (26)..(142): Pfam Name: DUF1264 Pfam Description: Protein of unknown function (DUF1264)
MASSDGKPLPTPASVGGGGGSSTAPPGQPTTVASKVLDMGAAAMQSLRPVKQAKQHMCTFALYAHDPKRQVGDAPLRLPAQPGLPSSGAVYYFGQSRRASHRRVSPSGRGKFFNSLPGGRTNRLWDPPPPPKIKPRPGEQTPHLGGVFLEKGELGPPVPPPFS

SEQ ID NO: 36737 - DNA, 618 bp, Zea mays
  misc_feature: Ceres CLONE 1421038-F
  misc_feature: Encodes the peptide sequence at SEQ ID NO. 36738
  misc_feature (380)..(380): n is a, c, t, g, unknown, or other
  misc_feature (393)..(393): n is a, c, t, g, unknown, or other
  misc_feature (411)..(411): n is a, c, t, g, unknown, or other
  misc_feature (449)..(449): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcgnaaagaggaatgcnagagcgagtgccgcgagncgcaccagcaagctgacgcgggcgaggacggcgacagncgcgtggacgcctacgtctcccgctccgggaggggcgagtgccggcgccagtgcctgcgccgcacgaagggccagcgtgggagaccaggaatgcatgaaggcgtgccgccgccgcggactggccgtcgacttggagcaagagtacggtcgcggcaaccaaaacccgggc

SEQ ID NO: 36738 - protein, 138 aa, Zea mays
  misc_feature: Ceres CLONE 1421038-F
  misc_feature (64)..(64): Xaa is any aa, unknown, or other
  misc_feature (70)..(70): Xaa is any aa, unknown, or other
  misc_feature (82)..(82): Xaa is any aa, unknown, or other
MGKGSVGASWWAFLLLAGVLLVVAATAGAEDGVVERDRKEDLRWCKQACEWQYGKDTPRKEECXSECREXHQQADAGEDGDXRVDAYVSRSGRGECRRQCLRRTKGQRGRPGMHEGVPPPRTGRRLGARVRSRQPKPG

SEQ ID NO: 36739 - DNA, 644 bp, Zea mays
  misc_feature: Ceres CLONE 1421041-F
ggagctccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagcttgatggctacatcagagcagtacaggaagtttggtgtgcactactccaacctagtaagcccggggtcttcttgctgctttaggaagtgtaccccgcttaaaatttagaaaaccttttgcccgaacctttccctgaagggggggggaattcccaaaattttgggcccacaccggaaacccttgggaacttttgtggtaaaaaaaaacaccccccccccccggggggggcttt

SEQ ID NO: 36740 - DNA, 661 bp, Zea mays
  misc_feature: Ceres CLONE 1421042-F
  misc_feature: Encodes the peptide sequence at SEQ ID NO. 36741
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcgaaaaaaaaaccgcaccgcaccgcaacgcgccaccgatccaccccgcgtcctcggcctccctccctccggcgagcggcggcgcgggcggccatggaggtgttctactacgtcgtgttcggcgcgctggccgccatcgtggcggggctcgagctcggcaagagcggcaaggaccgcgtcgccactacctccgcctttaactccttcaagaacaactacgtcctcgtctactccctcatgatgtccggggactggctgcagggcccctacgtctactacctctacagccagtacggcttcgacaagggcgacatcggccgcctcttcatcgccggcttcggatcctccatgctcttcggcaccatcgtcggctccctcgccgacaaacaaggccgcaagagggcctgcatcacctactgcatcagctacatcctcagctgcatcaccaagcactcccccgagtacagggtcctcatgatcggccgcatcctcggaggcatcgccacctcgctgctcttctccgccttcgagtcctggctcgtcgcagagcacaacaagagaggctn

SEQ ID NO: 36741 - protein, 157 aa, Zea mays
  misc_feature: Ceres CLONE 1421042-F
  misc_feature (4)..(157): Pfam Name: DUF791 Pfam Description: Protein of unknown function (DUF791)
MEVFYYVVFGALAAIVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAEHNKRG

SEQ ID NO: 36742 - DNA, 893 bp, Zea mays
  misc_feature: Ceres CLONE 1421063-F
  misc_feature: Encodes the peptide sequence at SEQ ID NO. 36743
  misc_feature (1)..(1): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
nttttttcccccccccccccnnnnnngtnngnnnnnngtnnggggnaagtgttttttttaagctggagctccccgcggtggcggccgctctagactagtggatcccccgggctgcaggaattcgcacgagaccattacctagaacatcctaatcgaaaagtcctcaatctcaatcccacaccaccaccgcctcctccggtccccaacccctgtcgcaccgcagccgccggccatggcctgcctcaccgacctcgtcaacctcaacctctcggacaacaccgagaagatcatcgcggaatacatatggatcgggggatctgggcatggatctccggagaaaagcaagggccctctccgggccggttaacggatccccagcaaggcttgccccagggtggaaacttacgacgggtttcagggacggggctaagggccccccggtaaagggacaggcggagggtctttccatggttaccccgcctggggccattccttacaaggggaccccagtttctaggagggggggcaacccacaccgtctcctcttggtggatgggggcgagagatggggataaaccccccccggtggtcgggagcgggggggtcgcatactcccgccgcgccccacacgaaggagggggtaccaaagagcgaccctccccaacaaaacctctttcaatgacgaccccctatgaaggggcccccccaccccaaaaaaaaaccctcgtgtcgattggggtcgttttggccccatgtgaatcctctccccccctccctccaaagaagggaaaacctaagcggggcccctctttggggaggggcccaaacgcaggggcgttcccccccgggccccccaggggggctcgctatacaccgggggggaaaatcccgcc

SEQ ID NO: 36743 - protein, 44 aa, Zea mays
  misc_feature: Ceres CLONE 1421063-F
  misc_feature: SWISSPROT Homolog: EC 6.3.1.2 Glutamate--ammonia ligase
MACLTDLVNLNLSDNTEKIIAEYIWIGGSGHGSPEKSKGPLRAG

SEQ ID NO: 36744 - DNA, 688 bp, Zea mays
  misc_feature: Ceres CLONE 1421065-F
  misc_feature: Encodes the peptide sequence at SEQ ID NO. 36745
  misc_feature (397)..(397): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaacccaacctcatcttctctccctttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttngttctcccgctcaggggaggcatgcagatcttcgtcaagaccctcactggaaaagactatccccctcgagggggagtcttctgaacccattcaaaacttcaaggccaaaatccaggaaaaggagggcattcccccggaacaggaggggttattttttgtgggaaaaaaactcggggaagggggccccctgggccaacttccaattttaaaaaggaagccccccccccctgggggttgccncccagggggggggatgcaaatttttcgaagaacccttagggggggaaattt

SEQ ID NO: 36745 - protein, 138 aa, Zea mays
  misc_feature: Ceres CLONE 1421065-F
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (70)..(70): Xaa is any aa, unknown, or other
MQIFVKTLTGKTITLEVESSDTIDNVKAKIQDKEGIPPDQQRLIFAGKQLEDGRTLADYNIQKESTLHLXSPAQGRHADLRQDPHWKRLSPSRGSLLNPFKTSRPKSRKRRAFPRNRRGYFLWEKNSGKGAPWANFQF

SEQ ID NO: 36746 - DNA, 709 bp, Zea mays
  misc_feature: Ceres CLONE 1421075-F
  misc_feature: Translation starting site: 207
  misc_feature (640)..(640): n is a, c, t, g, unknown, or other
  misc_feature (643)..(643): n is a, c, t, g, unknown, or other
  misc_feature (646)..(646): n is a, c, t, g, unknown, or other
aagctggagctccccgcggtggcggccgctctagaactagtggatcccccgggctgcaggaattcgcacgagaccattacctagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacaagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcctccgggctagacgccgacggcggcaagcggagccatttctccagcatcagaggtgacgacggccagaggtcgctcgacgcagtggtaaaaactgcccggcaggaggcccttccagtgagggttggcagccggagtctactcagggctcacgtacgcgctgcaggagccaggggatgccacgactggaagacagcggcatcgcaggcgcatccctggggcagccgtggcgctcactggtgacnccngcngccactccgacagcttggtaaattcgccatcacgggcgcgcgctctcagtggcgggagctggt

SEQ ID NO: 36747 - DNA, 673 bp, Zea mays
  misc_feature: Ceres CLONE 1421076-F
  misc_feature: Encodes the peptide sequence at SEQ ID NO. 36748
  misc_feature (673)..(673): n is a, c, t, g, unknown, or other
aaagctggagctccccgcggtggcggccgctctagaactagtggatcccccgggctgcaggaattcgcacgagaccattacctagaacatcctaatcgaaaaatcacgcaatcgagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacgtactatccgtcagaggctctcaagcataatggctctttgtatgctcatgtttacttcgcccgttcgggttatcctgtggaccctacagatccagaatatgagcagaaatcttcgtttgggaggacccatcctgtn

SEQ ID NO: 36748 - protein, 159 aa, Zea mays
  misc_feature: Ceres CLONE 1421076-F
MSQPAATVAAAAQPQGRGPAGRQGGLGQSIAGIVRMAVFWYFASKFFGPKRPPADPGMLMSNLFQKGEPMDMWMYLSENEKFNDFANEDALIWHEANIPYAVWGPTSTRTRSLTYYPSEALKHNGSLYAHVYFARSGYPVDPTDPEYEQKSSFGRTHPV

SEQ ID NO: 36749 - DNA, 698 bp, Zea mays
  misc_feature: Ceres CLONE 1421085-F
  misc_feature: Encodes the peptide sequence at SEQ ID NO. 36750
  misc_feature (345)..(345): n is a, c, t, g, unknown, or other
  misc_feature (371)..(371): n is a, c, t, g, unknown, or other
  misc_feature (376)..(376): n is a, c, t, g, unknown, or other
ggagctccccgcggtggcggccgctctagaactagtggatcccccgggctgcaggaattcgcacgagaccattacctagaacatcctaatcgaaaatttcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaaacaccaggaggacgtcgcgtggtactgncggaagcgaatggcctacatctacanggccnagacccagagcagcggcacccactaccgctgcatctgggggaagggtcgcccgcccgcatgggcaactccggcgtcgtcccgccccagttcaaggcccacctggcggccgaaatcaatgaaatccggagggggggaagaacccttttcctccaaaatttaccctcccgctgcccctggaaaggggttgtttccggggtaaaatttaaagggtgaaacttttctttctgaaaacctttaaaagtctcccagaatttgggggtttgggaccccgggaagtttttattgggggttttatgttggaccaaattttttttccccaat

SEQ ID NO: 36750 - protein, 126 aa, Zea mays
  misc_feature: Ceres CLONE 1421085-F
  misc_feature (12)..(90): Pfam Name: Ribosomal_L35Ae Pfam Description: Ribosomal protein L35Ae
  misc_feature (50)..(50): Xaa is any aa, unknown, or other
  misc_feature (59)..(59): Xaa is any aa, unknown, or other
  misc_feature (61)..(61): Xaa is any aa, unknown, or other
MVKGRTGQRVRLYVRGTVLGYKRSKSNQYETTSLVQIEGVKHQEDVAWYXRKRMAYIYXAXTQSSGTHYRCIWGKGRPPAWATPASSRPSSRPTWRPKSMKSGGGEEPFSSKIYPPAAPGKGLFPG

SEQ ID NO: 36751 - DNA, 631 bp, Zea mays
  misc_feature: Ceres CLONE 1421090-F
  misc_feature: Encodes the peptide sequence at SEQ ID NO. 36752
ctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataagatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccacccggggcgtgcttccggctccgcttctcgacgggcgggcaggcccacgggcaccttccggctaacggggcttgtccggggggggaaggccc

SEQ ID NO: 36752 - protein, 135 aa, Zea mays
  misc_feature: Ceres CLONE 1421090-F
  misc_feature (13)..(136): Pfam Name: MIP Pfam Description: Major intrinsic protein
MPINKIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTRGVLPAPLLDGRAGPRAPSG

SEQ ID NO: 36753 - DNA, 707 bp, Zea mays
  misc_feature: Ceres CLONE 1421092-F
  misc_feature: Encodes the peptide sequence at SEQ ID NO. 36754
acccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaacccatataggcttcaacaagcaatcgcagcaagcaacatacttttatcgccccttgttgtttcaaacaatcgccagccctatctttggtggcatcattggtacaaaccatcgggcaacaacagctggcagaacccggggttacctctgaatcaccaaatgagttctgggaaaaccttttctccctatctctcaggaaaaaacaatttttttccatttcaaaccaaatggtctaaccccgaaacccccgggtggttatttttgccgccaaccaacttttttacctttttttcccccgggtaagttatttggccattatttccaaaaaaaaaaaaaaaatttttttttcccattataacacaaaattgcgccgcccacaagaaacatcg

SEQ ID NO: 36754 - protein, 56 aa, Zea mays
  misc_feature: Ceres CLONE 1421092-F
MATKIFSLLMLLALSTCVANATIFPQCSQAPIASLLPPYLPSIIASICENPALQPI

SEQ ID NO: 36755 - DNA, 631 bp, Zea mays
  misc_feature: Ceres CLONE 1421093-F
  misc_feature: Encodes the peptide sequence at SEQ ID NO. 36756
tccccgcggtggcggccgctctagaactagtggatcccccgggctgcaggaattcgcacgagaccattacctagaacatcctaatcgaaaaaccccactccgccccacctccgcgcctcagatccatccccaaccggcaaccctagcgccgggttcctcctcctcggatccgcccgccgccgcgcggactccattgccagaggtgatcgagggggagagatagagcttgggtggtcggattagggagagagggaggggaggatgtccagacggtcgttgaacccgagccggcgggtggcggacgggggtctgccgacagtcggaggcctgttccaccccaagtcacgctcgcctcccgtgcttactattgccctagtcgtcctgggtgtcattcttctcgtcgcctacttcaacagcggctcaggtcggttaaagattctcggtgtaactggtacaagcagagagtctgtgaccaggtctgaaggttcttgcacatcagaagttatgcgggtgccttccctatcttaaaaagggatatgggaaatggccttgcaaaagggttctccctggtaggcccctgaaaatttggaacggaagtttcctaattttgttgaaaaaaaggaaaagggtt

SEQ ID NO: 36756 - protein, 88 aa, Zea mays
  misc_feature: Ceres CLONE 1421093-F
MSRRSLNPSRRVADGGLPTVGGLFHPKSRSPPVLTIALVVLGVILLVAYFNSGSGRLKILGVTGTSRESVTRSEGSCTSEVMRVPSLS

SEQ ID NO: 36757 - DNA, 546 bp, Zea mays
  misc_feature: Ceres CLONE 1421094-F
  misc_feature: Encodes the peptide sequence at SEQ ID NO. 36758
tggagctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaaccgcgtgcctggggagctggactgccttgacatgcaattcaggctaagggcaaagccccgggaaaaaaccctttggggggaggggtaataatggtttccacaccccctctccgggggagggggggggggggggaaaaaaccgtccccccccgttttttttttttgccttaacccccgtttccccgaaaagggaaaaaggggcccactccgggttttttcttccgggggggggtcttctaggggggggggggggggggggccccacattttttgggggggg

SEQ ID NO: 36758 - protein, 46 aa, Zea mays
  misc_feature: Ceres CLONE 1421094-F
MRECISIHIGQAGIQVGNRVPGELDCLDMQFRLRAKPREKTLWGEG

SEQ ID NO: 36759 - DNA, 629 bp, Zea mays
  misc_feature: Ceres CLONE 1421095-F
  misc_feature: Encodes the peptide sequence at SEQ ID NO. 36760
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggaccctctcgtgacgcggcgcgaggacctagtcgagcaggtgaggcacgcggccgggacggtgggcttcttctggctggtgacccacggatgccggaagagctgatgggcggcatgctccgcggggtgccccagtcaacgagggccccgggaaggcaaagcaggcgctctactcgagggacctcgttcgaacctgggcttcgccttcaacttcgaccttctcaagggtgcttgcggcgaatggggggaaccgcctctt

SEQ ID NO: 36760 - protein, 109 aa, Zea mays
  misc_feature: Ceres CLONE 1421095-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDPLVTRREDLVEQVRHAAGTVGFFWLVTHGCRKS

SEQ ID NO: 36761 - DNA, 627 bp, Zea mays
  misc_feature: Ceres CLONE 1421102-F
  misc_feature: Encodes the peptide sequence at SEQ ID NO. 36762
  misc_feature (503)..(503): n is a, c, t, g, unknown, or other
  misc_feature (572)..(572): n is a, c, t, g, unknown, or other
gctccccgcggtggcggccgctctagaactagtggatcccccgggctgcaggaattcgcacgagaccattacatagaacatcctaatcgaaaactttccctgctctctccttccaactcttgtttctgcaacgccagggcgcaaccatggatcagcagcagcaagggccggcggccaggcggatggccacgctcgcctcccacctgcgccatccctccgtctctcaccctcagatggaagatgttcccctcttgaggggatccaattgccgtgcaaaaggtgcggcgccaggcttcaaagtcgcgatcttgggtgcagcaggtgggatcgggcagccacttgcgctattgatgaagatgaaccctcttgtttcggtgctccatctatacgatgtcgtcaacgcacctggtgtcacagccgacatcagccacatgaacactggtgctgtggtacgtggctttctgggccagcacagttggaaaatgccctggctggaatggatnctgtaataatcctgctggtgtccctcggaaacctgggatgacaagggatgatttgttcaacataatgcntgaatagcccgaaccctgtgtgaaggaaatgcaaaagctgccctaatgcattggg

SEQ ID NO: 36762 - protein, 120 aa, Zea mays
  misc_feature: Ceres CLONE 1421102-F
  misc_feature (50)..(114): Pfam Name: Ldh_1_N Pfam Description: lactate/malate dehydrogenase, NAD binding domain
  misc_feature: SWISSPROT Homolog: EC 1.1.1.37 Malate dehydrogenase
  misc_feature (119)..(119): Xaa is any aa, unknown, or other
MDQQQQGPAARRMATLASHLRHPSVSHPQMEDVPLLRGSNCRAKGAAPGFKVAILGAAGGIGQPLALLMKMNPLVSVLHLYDVVNAPGVTADISHMNTGAVVRGFLGQHSWKMPWLEWXL

SEQ ID NO: 36763 - DNA, 761 bp, Zea mays
  misc_feature: Ceres CLONE 1421113-F
  misc_feature: Encodes the peptide sequence at SEQ ID NO. 36764
gcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtcccatgtgccgccgccggttcatctgccgccgccaccatgccactacccctactcaaccgccccgggctcagcctcatccccagccacacccatgcccgtgccaacagccgcatccaaacccgtgcccagctgcaggggaacctgcggcggttggccccacccccaatccctgggcccagggcgtccaggtttctggaggtatcagtgcagccccgacggggaacgcccttacttgctccccctcaggtgccagctcgtttggccggagcaagggttttcccagcatgcttcgagccagggtgagagccccccaacaccccggtttcgcagggcgaatctctcgcggttttgggcccctcacaatcccaattcctctggagatataaaaaacccca

SEQ ID NO: 36764 - protein, 170 aa, Zea mays
  misc_feature: Ceres CLONE 1421113-F
MRVLLVALALLALAASATSTHTSGGCGCQPPPPVHLPPPVHLPPPVHLPPPVHLPPPVHLPPPVHLPPPVPCAAAGSSAAATMPLPLLNRPGLSLIPSHTHARANSRIQTRAQLQGNLRRLAPPPIPGPRASRFLEVSVQPRRGTPLLAPPQVPARLAGARVFPACFEPG

SEQ ID NO: 36765 - DNA, 670 bp, Zea mays
  misc_feature: Ceres CLONE 1421119-F
  misc_feature: Encodes the peptide sequence at SEQ ID NO. 36766
  misc_feature (622)..(622): n is a, c, t, g, unknown, or other
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaataactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtcgggcgcgctggggctcggggggctgtcctcgctcacgtgcctcgcaacacggcgcggcaggcgttccagcgcaccccggactacgtgaaggagcgcnacgcangatggcggaagccgcgcgcacgcggcccacagacgcgcagga

SEQ ID NO: 36766 - protein, 135 aa, Zea mays
  misc_feature: Ceres CLONE 1421119-F
  misc_feature (44)..(136): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSGALGLGGLSSLTCLATRRGRRSSAPRTT

SEQ ID NO: 36767 - DNA, 603 bp, Zea mays
  misc_feature: Ceres CLONE 1421123-F
  misc_feature: Encodes the peptide sequence at SEQ ID NO. 36768
ggagctccccgcggtggcggccgctctagaactagtggatcccccgggctgcaggaattcgcacgagaccattacctagaacatcctaatcgaaaattttacgcggttacccctaactcccagctccctcgttcaggcgcgctctctctagccggcgacgattgggcgagcggcgccactcaacgccaggtcttcgtgaaaaccatcgccggcgatgagtttcaaccagtctactgtcaaggggcaggccaggagggagaggcctagggctcgccctcatggcctgacgcagcagaggaggcaggaaataaaggaagcctttgatctgtttgatacagataactctgggaaccattgatgcaaaagagctcaatggttgccatgagaagcctggggaatttgaagatgaactggaaaaaaccaaatttttgggccaaaaagaaagttgcccgcaaaaggtgttcaaaaaaaaaaagggggcgggggggggcccccctccccctcaagaggggggtttttgcccccctttttgtgcggcgcccccaaaccgggggaagaggggggggggtttaaaaaaaaggggcggccttcccccccacccca

SEQ ID NO: 36768 - protein, 47 aa, Zea mays
  misc_feature: Ceres CLONE 1421123-F
MSFNQSTVKGQARRERPRARPHGLTQQRRQEIKEAFDLFDTDNSGNH

SEQ ID NO: 36769 - DNA, 667 bp, Zea mays
  misc_feature: Ceres CLONE 1421124-F
  misc_feature: Encodes the peptide sequence at SEQ ID NO. 36770
  misc_feature (387)..(387): n is a, c, t, g, unknown, or other
  misc_feature (407)..(407): n is a, c, t, g, unknown, or other
aagctggagctccccgcggtggcggccgctctagaactagtggatcccccgggctgcaggaattcgcacgagaccattacctagaacatcctaatcgaaaaagggaggccgcccccgtcacccatagccaaagtcacgcgccaccaaactttgttctctcacccagtcgctttcgcgttcagcgcgagccgagcccagccggtgggtcggtcgctgaaggcggagccataaaggcgtcggcgacggcaggatgatgagcggcagatcgggcggcagggacggcgaggcggccggccccgtcatcaggatcagggtttcccacggagccaccttccgcgaggtcgtcgtgccggcgcaggctaccttcggtgagttgaagaggatccnttgtcagactactggcttgnagcctgagaggcagaagctcttcttccgtgggaaggagaagagtgacagaaagttcctccacgcggcaggtggtaaggaatgcgcgaaattgcttctgcttgaaaaagcttcccccttcaacataaaagcaaaaggtggaccctgtgattatggattaaaaccttattaaagccttgaaggcttttcctcgggtttaaaacctaaaattaaagggctgtctgccaaaggggtgggaacctggaaaaaaaaatggcttttc

SEQ ID NO: 36770 - protein, 108 aa, Zea mays
  misc_feature: Ceres CLONE 1421124-F
  misc_feature (46)..(46): Xaa is any aa, unknown, or other
  misc_feature (53)..(53): Xaa is any aa, unknown, or other
MMSGRSGGRDGEAAGPVIRIRVSHGATFREVVVPAQATFGELKRIXCQTTGLXPERQKLFFRGKEKSDRKFLHAAGGKECAKLLLLEKASPFNIKAKGGPCDYGLKPY

SEQ ID NO: 36771 - DNA, 714 bp, Zea mays
  misc_feature: Ceres CLONE 1421130-F
  misc_feature: Encodes the peptide sequence at SEQ ID NO. 36772
  misc_feature (542)..(542): n is a, c, t, g, unknown, or other
  misc_feature (548)..(548): n is a, c, t, g, unknown, or other
  misc_feature (590)..(590): n is a, c, t, g, unknown, or other
  misc_feature (698)..(698): n is a, c, t, g, unknown, or other
ggagctccccgcggtggcggccgctctagaactagtggatcccccgggctgcaggaattcgcacgagaccattacctagaacatcctaatcgaaaaagagcgcaagatgttcggcttcgggcaccacggccaccacggccagaacccgccggcgcaccccccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacngcgacnagggcccacggcgcgtgcacgacggcaccaccgtggtgctgntggagtgggccaagggagacaaccagagctggaagatccctgcctggggcgacgaagcctacgccgcgggaggcagcagcgccgcccacgcgcccccgcttcggcggnggcggcgagcccacgg

SEQ ID NO: 36772 - protein, 202 aa, Zea mays
  misc_feature: Ceres CLONE 1421130-F
  misc_feature (146)..(146): Xaa is any aa, unknown, or other
  misc_feature (148)..(148): Xaa is any aa, unknown, or other
  misc_feature (162)..(162): Xaa is any aa, unknown, or other
  misc_feature (198)..(198): Xaa is any aa, unknown, or other
MFGFGHHGHHGQNPPAHPPAHGGVHQPTFKIFCKADEGYCLTVRDGNVVLAPANPRDEHQHWYKDMRFSTQVKDEEGNPAFALVNKATGLAIKHSLGQSHPVKLVPFNPEYQDESVLWTESGDVGKGFRCIRMVNNIRLNFDAFHXDXGPRRVHDGTTVVLXEWAKGDNQSWKIPAWGDEAYAAGGSSAAHAPPLRRXRRAH

SEQ ID NO: 36773 - DNA, 699 bp, Zea mays
  misc_feature: Ceres CLONE 1421131-F
  misc_feature: Encodes the peptide sequence at SEQ ID NO. 36774
  misc_feature (338)..(338): n is a, c, t, g, unknown, or other
  misc_feature (355)..(355): n is a, c, t, g, unknown, or other
tggagctccccgcggtggcggccgctctagaactagtggatcccccgggctgcaggaattcgcacgagaccattacctagaacatcctaatcgaaaagaggaaaaatctcgcattcgcaaaccaagcaaatggaggcatgagctccgccgcctccccgtctctcgccgatctcccccaaaccctagcctcgacctgaccgccagcgggcccgcaggccggagaaggagtcggagtcgcccccacccacccaccctctgccgcgggcggggagcgggcggcggacgagatgccgtcgcacggggatctggaccggcagatcgcgcagctgcgcgactgncagtacctgcccgaggncgaggtcaaggtgctctgcgagcaggccaaggccatccctcatggagaatggaacgtgcagcccgtgcgctgccccgtcaccgtctgcggcgacatcccacgccagttctatgacctcatcgagctctttcggatcggcggggactctcccgacacaactaactctttattgggcgactacctcgatcggggcttattatccagttgaaaccggttctccggtaggggcttttaaaaccccgttaccaaagtaaaaattccattcctccgggaaatctgggaaccaaaaaatccctccaggggcgggctttcaggaagaaagcttaaaaaaaatttggaaagga

SEQ ID NO: 36774 - protein, 91 aa, Zea mays
  misc_feature: Ceres CLONE 1421131-F
  misc_feature: SWISSPROT Homolog: EC 3.1.3.16 Phosphoprotein phosphatase
  misc_feature (17)..(17): Xaa is any aa, unknown, or other
  misc_feature (23)..(23): Xaa is any aa, unknown, or other
MPSHGDLDRQIAQLRDXQYLPEXEVKVLCEQAKAIPHGEWNVQPVRCPVTVCGDIPRQFYDLIELFRIGGDSPDTTNSLLGDYLDRGLLSS

SEQ ID NO: 36775 - DNA, 820 bp, Zea mays
  misc_feature: Ceres CLONE 1421134-F
  misc_feature: Encodes the peptide sequence at SEQ ID NO. 36776
  misc_feature (719)..(719): n is a, c, t, g, unknown, or other
  misc_feature (820)..(820): n is a, c, t, g, unknown, or other
ccccgcggtggcggccgctctagaactagtggatcccccgggctgcaggaattcgcacgagaccattacctagaacatcctaatcgaaaaaaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgacgactacaaccgcgtcgcccgcgacacccgcaagcgcgtcgtcggcgtcctcctcggcacctcatgccggcgggtgcggccgatgtcgcccaactcttacgccgtggccggttggaggcaggatgaacacggaatcctaaggatcctggtgccctggagcgacgattagcgaggagtccattggttctcccctggttctggaagaatttattggccaaaggaacctttggttctacggctttgttactaggccctggccccggattctaaggtggaccaaccgccccttggcaggttcccccgctatgtcttgtcacgcgggtggggttgccatacgcccaaagcctctgggtggtctacgtcgggtgccctctaaccctccgtggagcgctgcggtgctagccgcacggaaatgcggcctatgttgtcctttggaagagggagggtnataatacggataggtgccatctgggaaaaaaatgtcccgccagggtaatttgctgtcctggcggtgcgtgaccacaacaagggcgcccctgcacggggaan

SEQ ID NO: 36776 - protein, 84 aa, Zea mays
  misc_feature: Ceres CLONE 1421134-F
MDVVKAAQLSGRTLERVVVHPLVLLSIVDDYNRVARDTRKRVVGVLLGTSCRRVRPMSPNSYAVAGWRQDEHGILRILVPWSDD

SEQ ID NO: 36777 - DNA, 664 bp, Zea mays
  misc_feature: Ceres CLONE 1421135-F
  misc_feature: Encodes the peptide sequence at SEQ ID NO. 36778
  misc_feature (37)..(37): n is a, c, t, g, unknown, or other
  misc_feature (212)..(212): n is a, c, t, g, unknown, or other
  misc_feature (300)..(300): n is a, c, t, g, unknown, or other
  misc_feature (391)..(391): n is a, c, t, g, unknown, or other
  misc_feature (397)..(397): n is a, c, t, g, unknown, or other
  misc_feature (398)..(398): n is a, c, t, g, unknown, or other
tccccgcggtggcggccgctctagaactagtgggatntcttgggctgcaggaattcgcacgagaccattacctagaacatcctaatcgaaaaaccctacactgagaaccgcagagacaggcgtcttcgtactcgcctatctccgcgactcaaagctttccccaattcccccccttctcccatttctcaccaccgccgccgctccccccgttnaacaacaccatgagggagtgcatctcgatccacatcggccaggctggtatccaggtccgaaacccgtgctgggagctgtactggctcnagcatggcattcatgctgatggccaaatgccccgggacaagacccttgggggatgtgacccccccctcgagggggggaggggggaaaattncccttnnaaaacacctccccccggctgtttttgttgaaccttgagccccccgtcgggggggggggggggggccgggcccttccgcccccctttttccccccgggagaggtgtggtgagggggggggggaggaatcctcctccaccacctttttgtctgcggggggccccgcccccccgttgcgggacggagaatgtggtgtggaccggggcgccgtgccccgcctctcgcaacctcgggcgccacaacgcccccgcggcgccccggcggggcc

SEQ ID NO: 36778 - protein, 68 aa, Zea mays
  misc_feature: Ceres CLONE 1421135-F
  misc_feature (27)..(27): Xaa is any aa, unknown, or other
  misc_feature (57)..(57): Xaa is any aa, unknown, or other
  misc_feature (59)..(59): Xaa is any aa, unknown, or other
MRECISIHIGQAGIQVRNPCWELYWLXHGIHADGQMPRDKTLGGCDPPLEGGRGENXPXKTPPPGCFC

SEQ ID NO: 36779 - DNA, 644 bp, Zea mays
  misc_feature: Ceres CLONE 1421139-F
  misc_feature (229)..(229): n is a, c, t, g, unknown, or other
  misc_feature (245)..(245): n is a, c, t, g, unknown, or other
  misc_feature (270)..(270): n is a, c, t, g, unknown, or other
  misc_feature (271)..(271): n is a, c, t, g, unknown, or other
  misc_feature (274)..(274): n is a, c, t, g, unknown, or other
  misc_feature (279)..(279): n is a, c, t, g, unknown, or other
  misc_feature (280)..(280): n is a, c, t, g, unknown, or other
  misc_feature (300)..(300): n is a, c, t, g, unknown, or other
  misc_feature (301)..(301): n is a, c, t, g, unknown, or other
  misc_feature (303)..(303): n is a, c, t, g, unknown, or other
  misc_feature (310)..(310): n is a, c, t, g, unknown, or other
  misc_feature (314)..(314): n is a, c, t, g, unknown, or other
  misc_feature (316)..(316): n is a, c, t, g, unknown, or other
  misc_feature (317)..(317): n is a, c, t, g, unknown, or other
  misc_feature (326)..(326): n is a, c, t, g, unknown, or other
  misc_feature (327)..(327): n is a, c, t, g, unknown, or other
  misc_feature (330)..(330): n is a, c, t, g, unknown, or other
tccccgcggtggcggccgctctagaactagtggatcccccgggctgcaggaattcgcacgagaccattacctagaacatcctaatcgaaaaaccctaatccgtatcccatcccaattcacaagccgccgtgacctctccatttcttccgcacgcatccctcgccgcctcgcgcctgcaccggagaatcggtcccattgcccgcgaacctgcgtgtgtgaggtatcgaanaccccaagatgggaantttcgcctcaccactcctctggaannttnatggnnatagaaaagaagaacgctcnntnaggtgancaananncaaaaaagnngtncccgaagcctgaagacttcccccccccggggcgcccgccaacattgccctttcccgggcttgggagcgagggcagaatggacccacgaagatgtttaaaaggggaagctcgttggccccaagggacgggaaagcgtgatcccactggccggagaaaccctcacttttttgaaagggggcccaaggaacgcgggtttctaacgccgccccctaacccccgggcgggggcttgttcgcctggctccaaagggggggccccgggaaaaatggtacctcgggaaagcctctcccccccaaacccaagagggcgaaccc

SEQ ID NO: 36780 - DNA, 637 bp, Zea mays
  misc_feature: Ceres CLONE 1421146-F
tcagaactagtggatcccccgggctgcaggaattcgcacgagaccattacctagaacatcctaatcgaaaaaattcgcctgcacctccccgcttcctccttgaccgccagcgttgacgtcgtcttccggccaggttgctcgccggaagacctcacctggacttttccgacgcacactctacacactctgtaaccctccggaatggccgcctgcttccagctcgtcgacgccacaatctccgcattgacttcgtcgacagccccatccgcctcttctcggtcgtcgctacagctcctctggctggtggctctggtgatccacatcgccgtatcctactccggctatctgcctctacatccccgcgggtcccagggtgaccggttctcctccccctccgccataggcacccgcctcctccatgacggggcctggctccccttctgcatattcacctacacttgccagcccgagcagcaccgcggcagcggcagcgaccgccatgacggaggcgactacaaccacgccgaagccccatgtccatcacccccggaagctcacttcgttgctggctcacgcctagcgatgctgtatcagtccaagtcgcccgccgccgatctactagccggggcgcccgccc

SEQ ID NO: 36781 - DNA, 647 bp, Zea mays
  misc_feature: Ceres CLONE 1421154-F
  misc_feature: Encodes the peptide sequence at SEQ ID NO. 36782
ctggagctccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattact

SEQ ID NO: 36782 - protein, 151 aa, Zea mays
  misc_feature: Ceres CLONE 1421154-F
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQIT

SEQ ID NO: 36783 - DNA, 647 bp, Zea mays
  misc_feature: Ceres CLONE 1421161-F
  misc_feature: Encodes the peptide sequence at SEQ ID NO. 36784
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactgggactccccgcggtggcggccgctctagaactagtggatcccccgggctgcaggaattcgcacgagaccattacctagaacatcctaatcgaaaaaaaaaaccctcttctcctctgtccgagattcatacaaaaatgcttctcaaatccgcttctgctttctcgctcgtgaacatccatggaggagtcaacaaggacatctctcctctctcctcctcctcctcctcttcattgagtcttcccgtttcttcgggaaaaatcagaaacctctccttctctggttctgcctccacgcaaaccctgagcggcgtcgttttcgagccgtttttgagagtgaagaaggagctcgatctcgtccctttcgagtcacagcttcttcttcgctcgccatctatacctccccccaaagggaaaacccccccctgaaaaaaaacaaaacaagggggagaaacccggtccatagggttaacccccttttggccctttttttctattgggaaaacattttctctcaaagggtttgcccaatttttt

SEQ ID NO: 36784 - protein, 96 aa, Zea mays
  misc_feature: Ceres CLONE 1421161-F
  misc_feature: SWISSPROT Homolog: EC 1.16.3.1 Ferroxidase
MLLKSASAFSLVNIHGGVNKDISPLSSSSSSSLSLPVSSGKIRNLSFSGSASTQTLSGVVFEPFLRVKKELDLVPFESQLLLRSPSIPPPKGKTPP

SEQ ID NO: 36785 - DNA, 665 bp, Zea mays
  misc_feature: Ceres CLONE 1421162-F
  misc_feature: Encodes the peptide sequence at SEQ ID NO. 36786
tggagctccccgcggtggcggccgctctagaactagtggatcccccgggctgcaggaattcgcacgagaccattacctagaacatcctaatcgaaaatttttttccccgctctgctctgcacgcccctctcctccctagtccctccccctacccccgcccgtcaaagcgagagcgccgtatcacctgtctctccgtccaccgccgtctcgatccgcgcccaaagatacctttcccccaccccttcctcgcgccgccgttttggtgcaaccatgacggcggagggggaggccaagaacccgtcggccggtggcggaggggataacccccagcaccatcaggctgcgccggcgccggcgccggcacagggggaagtggcgcatgaggctgcattgctcgggacgggacaagagcaggagctggacaaggtggatcgagaggtgcacggcggcccgagggagaatgactacggcacgtgcagagatctgatcctggtcgaggatccggaggtcctctccgtcgaggatccggaggaagctgcaccaaccgctccactccaagaagaaatgaaagcgcttgtggcatctatccctgatggtgctggaccagacttcacacccatgcaacttcaggagctacagcaccagtcccgggtgtaccactcatg

SEQ ID NO: 36786 - protein, 131 aa, Zea mays
  misc_feature: Ceres CLONE 1421162-F
MTAEGEAKNPSAGGGGDNPQHHQAAPAPAPAQGEVAHEAALLGTGQEQELDKVDREVHGGPRENDYGTCRDLILVEDPEVLSVEDPEEAAPTAPLQEEMKALVASIPDGAGPDFTPMQLQELQHQSRVYHS

SEQ ID NO: 36787 - DNA, 692 bp, Zea mays
  misc_feature: Ceres CLONE 1421180-F
  misc_feature: Encodes the peptide sequence at SEQ ID NO. 36788
  misc_feature (405)..(405): n is a, c, t, g, unknown, or other
  misc_feature (414)..(414): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacatcctaatcgaaaagaagccagagaaaaggttactccgcagaaagcaaaaccctagcccactccggcgcgccaccggccgatggtttcgatgagcaccacgccgaagccgcttgactccgccgtcgtcagcgcagccgttgacggcggggatgagggtggtggtggaggcggtggcgggaagaagcaggcgcacggggcggtgatggcgccgccaccgatggtggtcccggccgcggcgcccgcggccgaggaggaggttcggaaggtcaggaagccgtacaccatcaccaagtcgcgggagagctggacggagccngagcacgancagttcctcgaggccctgcagctttttgatcgtgattggaagaaaatgangcatatgttggcctcaagactgttatacagaataagagccatggccagaaatacttccctgagggttccaaagaatgggtacgggcaaccttttgcccccccccgggcaaaaacaaaagggcgccttcttccttttccccgaaaggggctctaaaaatgttttcccaaagccttttttttcccaagaacaaaccctccccaaaagggaaccaagggtttctttccttc

SEQ ID NO: 36788 - protein, 149 aa, Zea mays
  misc_feature: Ceres CLONE 1421180-F
  misc_feature (82)..(82): Xaa is any aa, unknown, or other
  misc_feature (99)..(99): Xaa is any aa, unknown, or other
MVSMSTTPKPLDSAVVSAAVDGGDEGGGGGGGGKKQAHGAVMAPPPMVVPAAAPAAEEEVRKVRKPYTITKSRESWTEPEHXQFLEALQLFDRDWKKMXHMLASRLLYRIRAMARNTSLRVPKNGYGQPFAPPRAKTKGRLLPFPRKGL

SEQ ID NO: 36789 - DNA, 672 bp, Zea mays
  misc_feature: Ceres CLONE 1421182-F
  misc_feature: Encodes the peptide sequence at SEQ ID NO. 36790
  misc_feature (672)..(672): n is a, c, t, g, unknown, or other
caaagctggagctccccgcggtggcggccgctctagaactagtggatcccccgggctgcaggaattcgcacgagaccattacctagaacatcctaatcgaaaagtacccggcagctccgctccgtcagtccgtccgcccccaagaatgtcagacgaggccaggcgcgggcccgcgggcgccgcgcaggtggtgcttcgggcctcctccgaggaccgcaagccggtgggctcggggtctccgccgccggcagcgaccgcgactgcggttgcgcacaagatccagctcaagagtgccgacatgaaggaggagatgcggcaggaggccttcgaaattgctcgcatcgcattcgagaagcacagtatggagaaggacatcgcggagtacataaagaaggagttcgacaagaaccacggcccaacctggcactgcatcgtcggccgcaacttcggttcctacgtgacgcacgagacaaactactttgtatatttctacatcgactctaaagctgtcttgctattcaagtctgggtgattgtcgcagccaatagagtcaaccttgcatgcctacatcttctttctctcgtgtatgctccatcccctcccctttcccctcagagtcgtctgcagccaagcctggaagccggtaatcttatgagccaaactttccatggn

SEQ ID NO: 36790 - protein, 128 aa, Zea mays
  misc_feature: Ceres CLONE 1421182-F
  misc_feature (40)..(128): Pfam Name: Dynein_light Pfam Description: Dynein light chain type 1
MSDEARRGPAGAAQVVLRASSEDRKPVGSGSPPPAATATAVAHKIQLKSADMKEEMRQEAFEIARIAFEKHSMEKDIAEYIKKEFDKNHGPTWHCIVGRNFGSYVTHETNYFVYFYIDSKAVLLFKSG

SEQ ID NO: 36791 - DNA, 544 bp, Zea mays
  misc_feature: Ceres CLONE 1421197-F
  misc_feature (84)..(84): n is a, c, t, g, unknown, or other
  misc_feature (236)..(236): n is a, c, t, g, unknown, or other
  misc_feature (244)..(244): n is a, c, t, g, unknown, or other
  misc_feature (265)..(265): n is a, c, t, g, unknown, or other
  misc_feature (266)..(266): n is a, c, t, g, unknown, or other
  misc_feature (272)..(272): n is a, c, t, g, unknown, or other
  misc_feature (273)..(273): n is a, c, t, g, unknown, or other
  misc_feature (357)..(357): n is a, c, t, g, unknown, or other
  misc_feature (360)..(360): n is a, c, t, g, unknown, or other
  misc_feature (367)..(367): n is a, c, t, g, unknown, or other
aaagctggactccccgcggtggcggccgctctagaactagtggatcccccgggctgcaggaattcgcacgagaccattacctangaacatcctaatcgaaaaaccagagagtcagagtgcggaggtgaacgtgacgtgacgctcctcctctataaaaggagacgcctgtgctgcagtgtgcacagcacagcccgtcgcgcgccgctgcgttgaggttgagccaaggcgcaatggcnaacctccnacctcagttttccgtctctgnntctcgnncgcgcgcggggctctctgctcccgctcgctgcgtgcagacagcactgtgcacggccgcgggagtgctcgcgactggctcaccgntcngctcggnggggcacacccgccacatagaagcggccagcacaccatgaaagcggccaatgccgcctggacccttcgtagtgcctcgaagccctccccgtaccgcgtaagtgcaacatttgcccccaaaaccttggaattacccaaccgtaagtgcccaaaaattccccttcccccaaaaccctgc

SEQ ID NO: 36792 - DNA, 723 bp, Zea mays
  misc_feature: Ceres CLONE 1421210-F
aaagctggagctccccgcggtggcggccgctctagaactagtggatcccccgggctgcaggaattcgcacgagaccattacctagaacatcctaatcgaaaaaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagcccgctaccctgctgcctacccccagcaatttcttccattcaaccaactagcagcattgaactctcctgcttttttacggcaccaacaactactaccattcgaccaactagctggtgtgatccctgatgaccctggtgc

SEQ ID NO: 36793 - DNA, 689 bp, Zea mays
  misc_feature: Ceres CLONE 1421219-F
  misc_feature: Translation starting site: 216
  misc_feature: SWISSPROT Homolog: EC 2.1.1.68 Caffeate O-methyltransferase
  misc_feature (689)..(689): n is a, c, t, g, unknown, or other
aaagctggagctccccgcggtggcggccgctctagaaactagtggatccccccggggcttgcagggaaattccgcaccaagacccatttaccttagaaaattccctaaactcgcaaaaaacctttcctgaggggtttccccccaagggtctccccccccaaaaccctaaaagagacttctttctccccccgaacaccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcctggagcggctgctccgcctgctggcgtcccgcggcgttttctccgagtccaccgagtccacgcccaccacgcggcggcggctattcgcgctcaccgcggtgggccgcaccctggtgccggggcccgcctcgggcgcgtcctacgccgactacgtgctgcagcaccaccaggacgcgctgtgtggcggcgtggccccgcctgcacgaggccgtgcttgaccccgcggggcccgagccgttcgcgcgcgccaacgccggggtcaccgcctacgcctactacggcaaggaccaggaccn

SEQ ID NO: 36794 - DNA, 733 bp, Zea mays
  misc_feature: Ceres CLONE 1421222-F
  misc_feature: Encodes the peptide sequence at SEQ ID NO. 36795
  misc_feature (566)..(566): n is a, c, t, g, unknown, or other
  misc_feature (713)..(713): n is a, c, t, g, unknown, or other
ccgcggtggcggccgctctagtttagtggatcccccgggctgcaggaattttcacgagaccattacctagaacatcctaatcgaaaaaaaatcctccacaccctggactggagtggctgctgctcgtggccggcgatgagcggcggcgggcccggaggtgcgtgcgggccggactcccgcgtggagaccatctcccggctggcgcagtggcgcatcgataccttcggcccctgctcctaccgccggtcggacccctttaagctcggcatctggaactggtacctgtcggtggagaagagccgctccatcgttgtgcgcctcttcccggagcccggccgggtggccaaggagcagccccctctcgcgcgcttcctgctccgcgtctcctgggccggcccgccgcgacgctcctgcgtctcccctgtgcacgagcatcttctgcgtaccagcgatgattttgtatggcaagtcgatgcgatgtcccatgggcgttttacgattgatgttgagtttctagacctgaggatagccacgaacaatgctaccgaatcgtcatcggtgtgggncaaacgaagggctggtggcagaagatccccaaggcagagcgcctcagggctggcctgtcgcgcttgctggggagacctccatccacgcccgacgtgaccattcaacacgaacgggacaggggtgcttaagagtgcacaaaagggganggcttggcgggcgtggcacc

SEQ ID NO: 36795 - protein, 175 aa, Zea mays
  misc_feature: Ceres CLONE 1421222-F
  misc_feature (144)..(144): Xaa is any aa, unknown, or other
MSGGGPGGACGPDSRVETISRLAQWRIDTFGPCSYRRSDPFKLGIWNWYLSVEKSRSIVVRLFPEPGRVAKEQPPLARFLLRVSWAGPPRRSCVSPVHEHLLRTSDDFVWQVDAMSHGRFTIDVEFLDLRIATNNATESSSVWXKRRAGGRRSPRQSASGLACRACWGDLHPRPT

SEQ ID NO: 36796 - DNA, 769 bp, Zea mays
  misc_feature: Ceres CLONE 1421223-F
  misc_feature: Encodes the peptide sequence at SEQ ID NO. 36797
aaagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcctttcaagatcaatggagtaccgatccgccgtgtgaaccagacctatggtcattgctacatcaaccaaaagttgacatcttctggtgttgattgcccccaaagtttgatgatcaagtacttttgccagggtagaaagaagctataagggtgaataagtacccgacgggcgaacttttttgtaaaccaaaaaacggaggccctccatagtgcccggccctggaccttcaataaaggattggaccgcgcaaagccagtccactttgatcgtaccggtggg

SEQ ID NO: 36797 - protein, 156 aa, Zea mays
  misc_feature: Ceres CLONE 1421223-F
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGPFKINGVPIRRVNQTYGHCYINQKLTSSGVDCPQSLMIKYFCQGRKKL

SEQ ID NO: 36798 - DNA, 741 bp, Zea mays
  misc_feature: Ceres CLONE 1421227-F
  misc_feature: Encodes the peptide sequence at SEQ ID NO. 36799
aaaagctggagctccccgcggtggcggccgctctagaactagtggatcccccgggctgcaggaattcgcacgagaccattacctagaacatcctaatcgaaaacgaaaaagaaaaaattcagcaaacaagcaaaggtacggccaccaccaccggccaggaagcaagctcaaaccctaaccgccggcgacgccagcacgatggcccgctacgaccgcgcgatcaccgtcttctcccccgacggccacctcttccaggtcgagtacgccctggaggccgtccgcaagggcaacgccgccgtcggcgtccgcggcacggacaccgtcgtcctcggtgtggagaagaagtcaacccccaagctccaggactccaggtccgtgcgcaagatcgcgtgcctggacacccacatcgctctggcatgcgcggggctgaaggcggacgcacgcgtgctcatcaaccgcgcgcgggtcgagtgccagagccaccgactcaccgtcgaggaccccgtcaccgtcgagtacatcacccgctacatcgctgggctgcagcagaatatacacagaagtggtggagtccgccctttcggcctctccacactcattgtcggcttcgacccctacaccgacaagccagcgctgtaccagaccgatccttctggtaccttctctgcttggaaggcgaacgccacgggaagggactccaactctatgcgtgagtttctgggagagaactacaaggagacc

SEQ ID NO: 36799 - protein, 181 aa, Zea mays
  misc_feature: Ceres CLONE 1421227-F
  misc_feature (27)..(180): Pfam Name: Proteasome Pfam Description: Proteasome A-type and B-type
  misc_feature: SWISSPROT Homolog: EC 3.4.25.1 Proteasome endopeptidase complex
MARYDRAITVFSPDGHLFQVEYALEAVRKGNAAVGVRGTDTVVLGVEKKSTPKLQDSRSVRKIACLDTHIALACAGLKADARVLINRARVECQSHRLTVEDPVTVEYITRYIAGLQQNIHRSGGVRPFGLSTLIVGFDPYTDKPALYQTDPSGTFSAWKANATGRDSNSMREFLGENYKET

SEQ ID NO: 36800 - DNA, 733 bp, Zea mays
  misc_feature: Ceres CLONE 1421230-F
  misc_feature: Encodes the peptide sequence at SEQ ID NO. 36801
  misc_feature (628)..(628): n is a, c, t, g, unknown, or other
  misc_feature (654)..(654): n is a, c, t, g, unknown, or other
  misc_feature (679)..(679): n is a, c, t, g, unknown, or other
  misc_feature (680)..(680): n is a, c, t, g, unknown, or other
acaagctggagctccccgcggtggcggccgctctagaactagtggatcccccgggctgcaggaattcgcacgagaccattacctagaacatcctaatcaaaaaaaaaccctagatctcgtcttgtcgccccgttcctccgatcccatcctatccgatcctcatggattcctcctcgtccagcctcagccagcagcccgagttcgactacctcttcaagctactccttatcggcgactccggcgtcggcaagagcagcctcctcctccgcttcaccgccgactccttcgatgacctctcccctaccataggtgatctctttgacttcgattatattccccgatctgaccgcttcaccgccgactccttcgatgacctctcccctaccataggtgttgacttcaaggtgaagatggttagcattggtggcaaaaaactcaagcttgcttgggacacagctggacaagagaggtttaggaccttgaccagctcttactacagaggggcacaggggatcattatggtgtatgatgtcagtcgacgagagacgttcaccaatctttctgatatatgggccaaggaaattgacctgtattcaacccacccagactgtgtaaagatgcttgttgnaaataaagtagacaaggaaagtgagnaggctgtcacgaaaaaggagggaanntgatttgccagggaatacggttgtttgtttctagaatgcagtgcgaaaacaaa

SEQ ID NO: 36801 - protein, 172 aa, Zea mays
  misc_feature: Ceres CLONE 1421230-F
  misc_feature (19)..(174): Pfam Name: Ras Pfam Description: Ras family
  misc_feature (156)..(156): Xaa is any aa, unknown, or other
  misc_feature (165)..(165): Xaa is any aa, unknown, or other
MDSSSSSLSQQPEFDYLFKLLLIGDSGVGKSSLLLRFTADSFDDLSPTIGDLFDFDYIPRSDRFTADSFDDLSPTIGVDFKVKMVSIGGKKLKLAWDTAGQERFRTLTSSYYRGAQGIIMVYDVSRRETFTNLSDIWAKEIDLYSTHPDCVKMLVXNKVDKESEXAVTKKEG

SEQ ID NO: 36802 - DNA, 736 bp, Zea mays
  misc_feature: Ceres CLONE 1421234-F
  misc_feature: Encodes the peptide sequence at SEQ ID NO. 36803
  misc_feature (736)..(736): n is a, c, t, g, unknown, or other
aaagctggagctccccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaattgaggtccctagtgaagaagtggcagacattaatcgaagcccatgttgatgtcaagacaaccgacaactacatgttgcgtttgttctgcatcggcttcaccaagaggcgcccaaaccaggtcaaggagacctgctatgctcaggcatcccagatccgtcagatccgccgttagatgggtaatattatgatcaaccaggcctcctcctggtgaccggaaagatctggtttccaagtcn

SEQ ID NO: 36803 - protein, 166 aa, Zea mays
  misc_feature: Ceres CLONE 1421234-F
  misc_feature (11)..(167): Pfam Name: Ribosomal_S3Ae Pfam Description: Ribosomal S3Ae family
MAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKETCYAQASQIRQIRR

SEQ ID NO: 36804 - DNA, 724 bp, Zea mays
  misc_feature: Ceres CLONE 1421235-F
  misc_feature: Encodes the peptide sequence at SEQ ID NO. 36805
  misc_feature (487)..(487): n is a, c, t, g, unknown, or other
tatagctggagctccccgcggtggcggccgctctagaactagtggatcccccgggctgcaggaattcgcacgagaccattacctagaacatcctaatcgaaaaatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtgtgcggcgttgttggagccttctctgtcgctcagcggcccggcgaccaaggatgatggcccgaccgcaccggtgaggaggttcgctgccgtgaagagggagctgcagacgatggaggggaacgacgacgaggccaccggcagggtacttgtctactccagtggcgtcgtcggncggtggttactgccgacgacgacgaagggtgcaacagcagccggaagaagctgaagctgtccaggagcattccgcgctgctggaggacacctccaaggagcacgcaccctcaccctaagcagaaggctgctttggccaaaaacttgacctgaacccaaggaatggggggttttggtccaaaaacaaaaagcccaaacccagcttaaaacacaaaaagggggccgggggattcccagg

SEQ ID NO: 36805 - protein, 106 aa, Zea mays
  misc_feature: Ceres CLONE 1421235-F
MEQEEVGLALGLSLGSGHHHQELKPQHPSHPCAALLEPSLSLSGPATKDDGPTAPVRRFAAVKRELQTMEGNDDEATGRVLVYSSGVVGRWLLPTTTKGATAAGRS

SEQ ID NO: 36806 - DNA, 744 bp, Zea mays
  misc_feature: Ceres CLONE 1421236-F
  misc_feature: Encodes the peptide sequence at SEQ ID NO. 36807
  misc_feature (463)..(463): n is a, c, t, g, unknown, or other
  misc_feature (471)..(471): n is a, c, t, g, unknown, or other
  misc_feature (486)..(486): n is a, c, t, g, unknown, or other
acaagctggagctccccgcggtggcggccgctctagaactagtggatcccccgggctgcaggaattcgcacgagaccattacctagaacatactaatcgaaaaacaccgcgaatcacaatatacgaaacaaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaagacgagcgggtgctgatgaatcagcgcaagngccccggnaggagcgccgagacnccaagtacctgcgcatggagcggcggatgggcaagtcatgccccagttcgtgctgccgaacaaccccacctgaacaagtcccccccctgtgcagggacgggtggctcacgggaaccttaaaaactcccccccccggacccaagaaaccccaaaacattcaaaattaaggccccctagggggaaacctttttcggaaaaaggccaagagactgggggggaacctggggaaacctgggggagaaaaaaaaatggaaaaaa

SEQ ID NO: 36807 - protein, 139 aa, Zea mays
  misc_feature: Ceres CLONE 1421236-F
  misc_feature (93)..(93): Xaa is any aa, unknown, or other
MDARMFGLENPLVAALHHLLDVPDGDAGAGGDKAGGGATRTYVRDARAMAATPADVKELAGAYAFVVDMPGLSTGDIRVQVEDERVLMNQRKXPGRSAETPSTCAWSGGWASHAPVRAAEQPHLNKSPPCAGTGGSREP

SEQ ID NO: 36808 - DNA, 710 bp, Zea mays
  misc_feature: Ceres CLONE 1421240-F
  misc_feature: Encodes the peptide sequence at SEQ ID NO. 36809
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagncggcacacaggcattggactggcccttatggctgctgcccagggctacaaacttacactcacattgccctgcctcatgagcatggaagaggagatctttttgaaggcttttgtgctgaaccttgtcctactgacccactcttggaatgaaaggactttcaagaggccgaagaaaatcagcaaaggaccccaatcttaaatccttcaacatttgaaaatcccgctacccaagattcctttgaagccactgggcctgaaaactggaaaaccc

SEQ ID NO: 36809 - protein, 143 aa, Zea mays
  misc_feature: Ceres CLONE 1421240-F
  misc_feature: SWISSPROT Homolog: EC 2.5.1.47 Cysteine synthase
  misc_feature (78)..(78): Xaa is any aa, unknown, or other
MGEASPSIAKDVTELIGNTPLVYLNKVTEGCVGRVAAKLESMEPCSSVKDRIGYSMITDAEEKGLITPGVSVLIEPTXRHTGIGLALMAAAQGYKLTLTLPCLMSMEEEIFLKAFVLNLVLLTHSWNERTFKRPKKISKGPQS

SEQ ID NO: 36810 - DNA, 722 bp, Zea mays
  misc_feature: Ceres CLONE 1421243-F
  misc_feature: Encodes the peptide sequence at SEQ ID NO. 36811
acaagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaagggtgggtgaagtggctcagtggcgtcatcgacaatgccctgtaccccgtcctcttcctggactacctcaagtccgccgtgcctgccctgggcggcggcccgccgagggcgttcgcggtgctcggactcacggcggtgctgacgctgctcaact

SEQ ID NO: 36811 - protein, 160 aa, Zea mays
  misc_feature: Ceres CLONE 1421243-F
MGECRTEYRGLPDANGEDAGTVPAALRKVSIVPLVFLIFYEVSGGPFGIEDSVGAAGPLLAIVGFLVLPVIWSIPEALITAELGTMFPENGGYVVWVASALGPYWGFQQGWVKWLSGVIDNALYPVLFLDYLKSAVPALGGGPPRAFAVLGLTAVLTLLN

SEQ ID NO: 36812 - DNA, 873 bp, Zea mays
  misc_feature: Ceres CLONE 1421244-F
  misc_feature: Translation starting site: 266
  misc_feature (36)..(36): n is a, c, t, g, unknown, or other
ttgcccccccatacacgtcgctttccatcaatctgngtggtggggggagggtgttaatttagggtggccctccgcgggggggggccgcctctctagaggagtcccctccgccggggtggatgtatgagtaccagaccgttagctagcaaatcctagtcgaaaacccccgatctcgctgtctgccatctgcgcgtccgtttctgcctctgtggcttgaaagtccactcgcacgtcgaaccatgggtaaggagagagtcccacatcaatgttgtggttcttggccgtgtcgactctggtaagtggaccgccccaggacaccttatctacaaggttggcggcattgactagagagtgatcgagaggttagagaaagaggctgctgagaatgaagaagccgtcctgcaagcgcgcgcgggtgctcttgattgagtttggtggctcagcaggatatagagatcaccattgatattgctgcagcggagatttgatatcgccaagtactactggcacgtgatcatatgcacgcccttagggagatcggtggacttcatcaaaatcaccttgacccactgagtaacctcacaagggctgacatgtgcttctcttgggtcggtgcgaacgatgccactaagtgagcaggcctctccaacgcccgggggtccttccgggggagaggccagcactctgtgtagacgtgcatcttcccttggggttccgccccctaagagttgataggaagatggatttagccatggtggcaatatacgaacgggtaaggctagtacacgccgcggaactacctttagtaagtctacggtatcttgtggatgttttctgccttaaaagtggagtgacccccatgctcctgtattg

SEQ ID NO: 36813 - DNA, 738 bp, Zea mays
  misc_feature: Ceres CLONE 1421245-F
  misc_feature (701)..(701): n is a, c, t, g, unknown, or other
  misc_feature (702)..(702): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaatcacacatattattgagaccaactagcaacatataaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcgtcagtaacaacatcctcctccatagcccgacctctcacacattccaacttggtgcggcgtaaacgcgcagcagcacttcgacccggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctcgatgctctccccatcgacacgcgagccccttggagggccnncgacntagattttactgagatttctcctcatcaacc

SEQ ID NO: 36814 - DNA, 802 bp, Zea mays
  misc_feature: Ceres CLONE 1421248-F
  misc_feature: Encodes the peptide sequence at SEQ ID NO. 36815
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (662)..(662): n is a, c, t, g, unknown, or other
  misc_feature (663)..(663): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (696)..(696): n is a, c, t, g, unknown, or other
  misc_feature (706)..(706): n is a, c, t, g, unknown, or other
  misc_feature (727)..(727): n is a, c, t, g, unknown, or other
  misc_feature (728)..(728): n is a, c, t, g, unknown, or other
  misc_feature (738)..(738): n is a, c, t, g, unknown, or other
  misc_feature (782)..(782): n is a, c, t, g, unknown, or other
  misc_feature (802)..(802): n is a, c, t, g, unknown, or other
tagctggagctccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtcaaaaccgattgtggtacttccccctgctaggggcgtggggaagcgcccgccctcctaacaaacgccgctggggtgatacccccccgcgcgcgccatctggctggcgatagatttattctgcacccgggagaacccccttttttcccccctaaaaaaaaaaccttccccttttatttttggaaaaaaaaatttttttccccaaaaaaaatttttttttgggggggggggggggggggggcccggagaaaaaaaaatttttccccacatttttttttgggggggggggggtgttttttttttcccccccccccccggggggggttttttttttttttcccccccaaaaaaaaaaaaaaggagggggggggtggggttgttatttttttcccccccccggggggggggggccccccccccacccaccccccccctcgcgggggggggggggggatcccccccaccccccccccccccccnnncccnnccccnannnnnnnnnnnnnnntggggggggggnggagggcgantttctcatattaaacaatcanncccctccttntcgggcggggggggtgggtgggggggggggaaaaaaaaaacaanaatcaacccccccccccccn

SEQ ID NO: 36815 - protein, 33 aa, Zea mays
  misc_feature: Ceres CLONE 1421248-F
MFASRSSPPLSPPCRRAPTASCPVKTDCGTSPC

SEQ ID NO: 36816 - DNA, 717 bp, Zea mays
  misc_feature: Ceres CLONE 1421260-F
  misc_feature: Encodes the peptide sequence at SEQ ID NO. 36817
  misc_feature (446)..(446): n is a, c, t, g, unknown, or other
  misc_feature (516)..(516): n is a, c, t, g, unknown, or other
  misc_feature (570)..(570): n is a, c, t, g, unknown, or other
  misc_feature (586)..(586): n is a, c, t, g, unknown, or other
  misc_feature (587)..(587): n is a, c, t, g, unknown, or other
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaaatgcacactcactcactccagtgcccactgcccactgcccactgcccgacgaggaagtttcacgatcccaacccgtataaatcgacgccgcgagggggagcgacgagcgatccccgtaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcattcaactccttcaagaacaactacgtcctcgtctactccctcatgatgtccggggactggctgcanggcccctacgtctactacctctacagccagtatggctttcgacagggcgacatcggccgcctcttcatcngcggcttcggatcctccatgctcttcggcaccatcgtcggctccctcgccgacnaacagggcgcagaggnnctgcntcacttattgcatcagctacatcctcagctgcatcacaagcactcccccgaagtacagggtcctcatggatccgccgcatcctcgggggaatcgccacctcgctgttcttctcggcttttaaggc

SEQ ID NO: 36817 - protein, 146 aa, Zea mays
  misc_feature: Ceres CLONE 1421260-F
  misc_feature (4)..(145): Pfam Name: DUF791 Pfam Description: Protein of unknown function (DUF791)
  misc_feature (56)..(56): Xaa is any aa, unknown, or other
  misc_feature (80)..(80): Xaa is any aa, unknown, or other
  misc_feature (98)..(98): Xaa is any aa, unknown, or other
  misc_feature (103)..(103): Xaa is any aa, unknown, or other
  misc_feature (105)..(105): Xaa is any aa, unknown, or other
MEVFYYVVFGALAAVVAGLELGKSGKDRVATTSAFNSFKNNYVLVYSLMMSGDWLXGPYVYYLYSQYGFRQGDIGRLFIXGFGSSMLFGTIVGSLADXQGAEXLXHLLHQLHPQLHHKHSPEVQGPHGSAASSGESPPRCSSRLLR

SEQ ID NO: 36818 - DNA, 601 bp, Zea mays
  misc_feature: Ceres CLONE 1421261-F
  misc_feature: Encodes the peptide sequence at SEQ ID NO. 36819
  misc_feature (172)..(172): n is a, c, t, g, unknown, or other
  misc_feature (258)..(258): n is a, c, t, g, unknown, or other
  misc_feature (336)..(336): n is a, c, t, g, unknown, or other
tggagctccccgcggtggcggccgctctagaactagtggatcccccgggctgcaggaattcgcacgagaccattacctagaacatcctaatcgaaaaaacgctcctgctcacagcgtgggggatcttcgcagagatggcgaggacctcgttcctgcagaagctggagcacanggtggaggcgtcggccgccgacttgcagcacatcgagtccatcgccctcgacaccgtctccttcgaggagctccctcgccactgcngcgaggcgctcaaagtctacgcgcggcacggccgacgcccttcagtcgcacctccgcttcttttgctacgagcccccngaccccaacacccccagatcgatgtggattgtgaaaatgaacatttcggaaaggttggggaacttggaaataattccccaacctttcccgtttcaaggctcaggtcggggaaacgggggtttatttcccccccgcgtgcccttttttaaagaccccccaaggaccttggggttttaaaaagttggtaacccccctttttttttaaggggcccctttttggggggccccccaaaaaccttttccaaaatccccaaaactccttgta

SEQ ID NO: 36819 - protein, 116 aa, Zea mays
  misc_feature: Ceres CLONE 1421261-F
  misc_feature (13)..(13): Xaa is any aa, unknown, or other
  misc_feature (42)..(42): Xaa is any aa, unknown, or other
  misc_feature (68)..(68): Xaa is any aa, unknown, or other
MARTSFLQKLEHXVEASAADLQHIESIALDTVSFEELPRHCXEALKVYARHGRRPSVAPPLLLLRAPXPQHPQIDVDCENEHFGKVGELGNNSPTFPVSRLRSGKRGFISPPRALF

SEQ ID NO: 36820 - DNA, 614 bp, Zea mays
  misc_feature: Ceres CLONE 1421269-F
  misc_feature: Encodes the peptide sequence at SEQ ID NO. 36821
  misc_feature (376)..(376): n is a, c, t, g, unknown, or other
  misc_feature (377)..(377): n is a, c, t, g, unknown, or other
  misc_feature (402)..(402): n is a, c, t, g, unknown, or other
aaaactggagctccccgcggtggcggccgctctagaactagtggatcccccgggctgcaggaattcgcacgagaccattacctagaacatcctaatcgaaaaagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctctcctccgccgcgctcctcgagcgcttcgccgcctccctcgaggagctctccgtcgcgagggcgcgcctctactcgctcgcggggctgccacgnnctccgggtgctcggcgcctcatccntccccgacaccgactctaggggggacgcgtcttcgacgacagtaacgaagcatgcggcgtcacgctgcgccaactcgacctaggtaacaaccggttcgcggagggtcaggagctcgcgccactcatcggggttcggggtcgagtccctcgacctgatccattggcccgatcacgaagtcaaggggtccagggatgaggtctcccccctaatc

SEQ ID NO: 36821 - protein, 88 aa, Zea mays
  misc_feature: Ceres CLONE 1421269-F
  misc_feature (75)..(75): Xaa is any aa, unknown, or other
  misc_feature (83)..(83): Xaa is any aa, unknown, or other
MAAAAAGEDDAAWERAISAATKSTSAPKTLTLDGAVKSSTGGLSSAALLERFAASLEELSVARARLYSLAGLPRXPGARRLIXPRHRL

SEQ ID NO: 36822 - DNA, 653 bp, Zea mays
  misc_feature: Ceres CLONE 1421273-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (142)..(142): n is a, c, t, g, unknown, or other
  misc_feature (146)..(146): n is a, c, t, g, unknown, or other
  misc_feature (340)..(340): n is a, c, t, g, unknown, or other
  misc_feature (420)..(420): n is a, c, t, g, unknown, or other
  misc_feature (573)..(573): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctgggaactccaccncggntggcggccgctctagaatagtggatcccccgggctgcaggaattcgcacgagaccattacctagaacatcctaatcgaaaaattttttttgtttggttgttcctctcgctcgccagtcgccaccaggcagcaggcatcccatctcgcgagagccagtagcggcggcggcgcttccggcttcccttcccattggnctccgggaatggcgctccgccctccacaagggtccgggttttgcctttccccggccgtttggccgccccgggccggccgngagggggggggggagttttttttgcccccccgtcccccccccattaaaaaatatccccgcccgcttttttccccaccagggggggggggaaaaaaaaaaaaaaaaccttttttttttttcccccccaaagaggagggaaaaatatcccccccnttttaaaaaacaaatttggggggggccccctccccccaaaagaaaagaaaaaaatgtttttnnnnnttttctttttctca

SEQ ID NO: 36823 - DNA, 741 bp, Zea mays
  misc_feature: Ceres CLONE 1421279-F
  misc_feature: Encodes the peptide sequence at SEQ ID NO. 36824
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (322)..(322): n is a, c, t, g, unknown, or other
  misc_feature (323)..(323): n is a, c, t, g, unknown, or other
  misc_feature (331)..(331): n is a, c, t, g, unknown, or other
  misc_feature (341)..(341): n is a, c, t, g, unknown, or other
  misc_feature (354)..(354): n is a, c, t, g, unknown, or other
nnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnccaaactgggactccccgcggtggcggccgctctagaatagtggatcccccgggctgcaggaattcgcacgagaccattacctagaacatcctaatcgaaactctgtctctctagggtttttgattttagccgccgccgctgctcatctcacatccctcgagaagacgcctgctactcgccgatcgatacgatgggcgtcttctccnngactccanccgcgacggnctcaagtccctcnaggctccactcgccggcaaaacctaggggtctggggaccccctttggaaaggaggacaattaagggccttccccccggggcccccccaaaccgtgggccttaaattcccaaaagcccccccccgggtaacaaaaaccccctcttccgggggtggggcccccccaaaaacccccgggaaaaagggggtgggggggaaaaaatccccccgggggaaaaaacctccccgggggaagggccccccccgggggaagggggggaggaaaaaaaagaacccccccttcttttttttgggggggaaaaaccgggggggaaaaaaaaggggggctttttaaaagggggggcccccccccccaaaaagatctcttttttaaaaaaaaaaaaaaaggg

SEQ ID NO: 36824 - protein, 36 aa, Zea mays
  misc_feature: Ceres CLONE 1421279-F
  misc_feature (6)..(6): Xaa is any aa, unknown, or other
  misc_feature (9)..(9): Xaa is any aa, unknown, or other
  misc_feature (12)..(12): Xaa is any aa, unknown, or other
MGVFSXTPXATXSSPSRLHSPAKPRGLGTPFGKEDN

SEQ ID NO: 36825 - DNA, 627 bp, Zea mays
  misc_feature: Ceres CLONE 1421281-F
  misc_feature: Encodes the peptide sequence at SEQ ID NO. 36826
  misc_feature (548)..(548): n is a, c, t, g, unknown, or other
  misc_feature (556)..(556): n is a, c, t, g, unknown, or other
agctccccgcggtggcggccgctctagaactagtggatcccccgggctgcaggaattcgcacgagaccattacctagaacatcctaatcgaaaaattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctacattattaaccttggaaagacctgggacaagcttcagttggccgccagggtcatcgttgccattgagaatccgcaggacattatcgtgcagtctgctaggccctatggccagagggctgtcctcaagtttgcgcagtacactggtgcccatgccattgctggcaggcacactcctggtacattcaccaaccagttgcaaacctccttcagtgagccacgccttttctatctgactgacccgaggactgatcatcagcccattaaggagtctgcccttggaaacatccnaccatcgncttctgtgaactgaatccctatgcccctatgtgattcgggattcccgcccaataccaggggaaaccgagca

SEQ ID NO: 36826 - protein, 154 aa, Zea mays
  misc_feature: Ceres CLONE 1421281-F
  misc_feature (23)..(155): Pfam Name: Ribosomal_S2 Pfam Description: Ribosomal protein S2
  misc_feature (148)..(148): Xaa is any aa, unknown, or other
  misc_feature (151)..(151): Xaa is any aa, unknown, or other
MAAAPAGGGPRALSQREQDIQMMLAADVHLGTKNCDFQVERYVYKRRTDGIYIINLGKTWDKLQLAARVIVAIENPQDIIVQSARPYGQRAVLKFAQYTGAHAIAGRHTPGTFTNQLQTSFSEPRLFYLTDPRTDHQPIKESALGNIXPSXSVN

SEQ ID NO: 36827 - DNA, 662 bp, Zea mays
  misc_feature: Ceres CLONE 1421286-F
  misc_feature: Encodes the peptide sequence at SEQ ID NO. 36828
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
tggagctccccgcggtggcggccgctctagaactagtggatcccccgggctgcaggaattcgcacgagaccattacctagaacatcctaatcgaaaattttttcgttcccctttccgccgcgcctcccactaaaccctagatctctctctctataatgccgacgtcttcggctctcagcaagcgcggcggcgacggcggggacggcatcctggccgccctctcccgttcgcaggtggcggcgcacgggcgagaggcggcggccgtggcgaagaagctgctgcggagcacggggaaggcggcgtggatcgcggggacaaccttcctggtgctggtggtgccgctgatcatcgagatggaccgggagcagcagctcaacgacctcgagctgcagcagcagacgcttctggggggggccccctcgncnngcgcggcgaacaagtagatagatccgtgcatcgacccttttcgtcccccttctccctcttagaaggatctgttactgccaagttcatcattcgagttcttatcaagtcatcattcgaggcccagcgaggttgagttacccacccaaccggtggcggttgggccaaaaaaaaaagggaaaaacgccttggtaaaaggccccccccccacacccaaaattaatttccccccccccaag

SEQ ID NO: 36828 - protein, 95 aa, Zea mays
  misc_feature: Ceres CLONE 1421286-F
  misc_feature (90)..(90): Xaa is any aa, unknown, or other
  misc_feature (91)..(91): Xaa is any aa, unknown, or other
MPTSSALSKRGGDGGDGILAALSRSQVAAHGREAAAVAKKLLRSTGKAAWIAGTTFLVLVVPLIIEMDREQQLNDLELQQQTLLGGAPSXXAANK

SEQ ID NO: 36829 - DNA, 585 bp, Zea mays
  misc_feature: Ceres CLONE 1421292-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (369)..(369): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccaccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaaccggcctncaacggnnnagtgccgggggctacggcgaacctcaaaggggggggggccggcatggcaccggcaaaggcgccccccacccccccaaaaaccggggggccctttattacaggggccttaaaggccccaaaagggccccaaaccttttgggggggtaaaaatttgggggtttttccggggtgaaacttggggcggggacccggtattttccccccccg

SEQ ID NO: 36830 - DNA, 645 bp, Zea mays
  misc_feature: Ceres CLONE 1421295-F
  misc_feature: Encodes the peptide sequence at SEQ ID NO. 36831
aaagctggagctccccgcggtggcggccgctctagaactagtggatcccccgggctgcaggaattcgcacgagaccattacctagaacatcctaatcgaaaaagattctgagcttctggggaaaaaggcaggcacagtatcgtctaacatgctgccaggtcgccacccggcgcgccgggacgacaccaccgggacggggccgctcctgccggacgccactcgcgcggtggtgtccgagttcgtcgccacagccatgttcgtgttcgccgcccaaggatccggctacggcctctggaagctgtacgatgacacggctgactccgggcggcctgctcacggtggccatcgcgcacacgctggcgatggtggtcgcggtggccgtagcgatcaacgcgtcgggtgggcacgtcaaccctgccgtcacggtcgggctggtcgtgggccgtcccatctctttcgagcgtgacgccgtatactggctcgcgcagatgctcctcggcgaggtcgccttgttgctgctaacgctcggctccgggggcacccggcccccggggctcccggctccgccccggcatccacgagcgggacgcggtcctggtaaaaggcgtcaagacggtaggggttctgtaccccatgtaccccacc

SEQ ID NO: 36831 - protein, 113 aa, Zea mays
  misc_feature: Ceres CLONE 1421295-F
MTRLTPGGLLTVAIAHTLAMVVAVAVAINASGGHVNPAVTVGLVVGRPISFERDAVYWLAQMLLGEVALLLLTLGSGGTRPPGLPAPPRHPRAGRGPGKRRQDGRGSVPHVPH

SEQ ID NO: 36832 - DNA, 610 bp, Zea mays
  misc_feature: Ceres CLONE 1421296-F
  misc_feature: Encodes the peptide sequence at SEQ ID NO. 36833
  misc_feature (206)..(206): n is a, c, t, g, unknown, or other
  misc_feature (283)..(283): n is a, c, t, g, unknown, or other
  misc_feature (310)..(310): n is a, c, t, g, unknown, or other
aagctggagctccccgcggtggcggccgctctagaactagtggatcccccgggctgcaggaattcgcacgagaccattacctagaacatcctaatcgaaaaacccctcagcgcgacgaaggtaagatgttcctgcggaggatcctgaccggcgggggcggcctggcggccctgagggcggcgcgcgccgtgaaggagacgacgggnatcgtgggcctttgagtggtgccctacgcgcgagaggttctgggtaggctctacgagcgcacgctcaaagagatcanggccgtccccgaagacgaaggttaccngcaggcccgttgaaatccttcaccggtcaccgcctccaaatcttgccgggaggaggaagactggaaaccccttcaaggacccaatcggattccgggcaggtccaggaactcttccaggaggcccaggacaagtctcaggcccttccctaaaaggatttaaggggatcccggggggtttttccaaaaacctccaaaggtggggggttttaaaaaaaaccccccatttctaaaaatggttcccccaacccccgcctgtttttcttcctcaggaaggttttttcagggccttaatagtgtcta

SEQ ID NO: 36833 - protein, 31 aa, Zea mays
  misc_feature: Ceres CLONE 1421296-F
MFLRRILTGGGGLAALRAARAVKETTGIVGL

SEQ ID NO: 36834 - DNA, 645 bp, Zea mays
  misc_feature: Ceres CLONE 1421303-F
  misc_feature: Encodes the peptide sequence at SEQ ID NO. 36835
  misc_feature (280)..(280): n is a, c, t, g, unknown, or other
  misc_feature (284)..(284): n is a, c, t, g, unknown, or other
  misc_feature (285)..(285): n is a, c, t, g, unknown, or other
  misc_feature (290)..(290): n is a, c, t, g, unknown, or other
  misc_feature (291)..(291): n is a, c, t, g, unknown, or other
  misc_feature (302)..(302): n is a, c, t, g, unknown, or other
  misc_feature (307)..(307): n is a, c, t, g, unknown, or other
  misc_feature (329)..(329): n is a, c, t, g, unknown, or other
  misc_feature (352)..(352): n is a, c, t, g, unknown, or other
agctccccgcggtggcggccgctctagaactagtggatcccccgggctgcaggaattcgcacgagaccattacctagaacatcctaatcgaaaactaaaaaccatcgccctgcccccgcctccgctgcatcccatggcggctgtgcagcgcctcctccgggcagtcgcccccggtggctcggcagcggcggcggtcaggaggcgcatgacgtcgcttgcgccggagcaggcgccgtcttcggccgctgggttccatttcgcgcggagcaaaaagcaagcngccnngtgcnngcgaaagaacntgcantgggtgttcctgggctgccccngcctgggccaaggcacctacccnagccgcctgtcccgcctcctcggggtgccgcaaatccggaacgggggaccttggtccccaacaagctccccctcccccgggcccctttgttaaccaacttggcttaaatttgttaattcggggaaaattagtttccagagaaaatatcccccaaccttttttgcccaaaggctttaaaaaaggggaaaacccggggaaaacccgggtttttttctgaagggttttcccccgcaaagaaaaaaaacgggaaattctcggaggggggtcaaaaattagaaaaggggggggataac

SEQ ID NO: 36835 - protein, 103 aa, Zea mays
  misc_feature: Ceres CLONE 1421303-F
  misc_feature: SWISSPROT Homolog: EC 2.7.4.3 Adenylate kinase
  misc_feature (51)..(51): Xaa is any aa, unknown, or other
  misc_feature (53)..(53): Xaa is any aa, unknown, or other
  misc_feature (57)..(57): Xaa is any aa, unknown, or other
  misc_feature (58)..(58): Xaa is any aa, unknown, or other
  misc_feature (66)..(66): Xaa is any aa, unknown, or other
MAAVQRLLRAVAPGGSAAAAVRRRMTSLAPEQAPSSAAGFHFARSKKQAAXCXRKNXXWVFLGCPXLGQGTYPSRLSRLLGVPQIRNGGPWSPTSSPSPGPLC

SEQ ID NO: 36836 - DNA, 708 bp, Zea mays
  misc_feature: Ceres CLONE 1421307-F
  misc_feature: Encodes the peptide sequence at SEQ ID NO. 36837
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (158)..(158): n is a, c, t, g, unknown, or other
  misc_feature (384)..(384): n is a, c, t, g, unknown, or other
  misc_feature (403)..(403): n is a, c, t, g, unknown, or other
  misc_feature (448)..(448): n is a, c, t, g, unknown, or other
  misc_feature (458)..(458): n is a, c, t, g, unknown, or other
nnnnnnnnnnnnnnnnnaaggggnnnnnnnnnnnnnnnnnnnnnnnnnnnnnnnnnnnnnnnnnnnnnnnnnnnnnnnnnnnnnnnnnnnnnnnnnnnnnnnnnnncaagctggggctccaccgcggtggcggccgctctagaactagtggatccccncgggctgcaggaattcgcacgagaccattacctagaacatcctaatcgaaaagcttcaatactagctcgctcaccactcaccagtcaccagtccagcaagcaacaacaaaggcgcaggaggaagcttgttttggaccgagcaagcgagccagccgagcgtgggagagagagagagaggaattaattgatgggcgaggaggccagctgcgacgccgtcagcctgacngagggcggcaccaacgccnagccggtgggcaaggagaaacggcgcgagccggctgcggctcccngccgcgcggncgacccccgggtgcagggcatctccgacggcatccgcgtcgtggcgcacttcccaagccagggatcatgttcaacgaaatcaccacgctgctgctgcgcccccagggggttcaaggaacgccgtccaacttgttcttccagcggtaaccgcgggatggggatttcaaccccctcccccgggatttagggccaggggctttcctgtttcgcccccgggaaaacccccctgggttttggggccccaaattat

SEQ ID NO: 36837 - protein, 99 aa, Zea mays
  misc_feature: Ceres CLONE 1421307-F
  misc_feature (20)..(20): Xaa is any aa, unknown, or other
  misc_feature (35)..(35): Xaa is any aa, unknown, or other
  misc_feature (38)..(38): Xaa is any aa, unknown, or other
MGEEASCDAVSLTEGGTNAXPVGKEKRREPAAAPXRAXDPRVQGISDGIRVVAHFPSQGSCSTKSPRCCCAPRGFKERRPTCSSSGNRGMGISTPSPGI

SEQ ID NO: 36838 - DNA, 781 bp, Zea mays
  misc_feature: Ceres CLONE 1421312-F
  misc_feature: Encodes the peptide sequence at SEQ ID NO. 36839
  misc_feature (74)..(74): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
ggtgcccgggcccccccccgggtcccttgggggggtggagtgattcccctcgcggtgcccccccgtgtggggcnggggtnnnnttcaaactggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgaagcagccacggccggggcggaggacggagtggtctaacgggaccgcaaggaggacctgcggtggtgccagcaggcgtgcgagtggcactacggaaaggacaccccgcggaagagggaatgcgagagcgagtgtccgcgagcgggcacccagcaagctgaccccgggggaagaacggccaacagcggggttggaaggcctacgtccttccccctccccgggaaggggtgaagatgccggccgccagttgccctggcgtcctccatgtaggggcccagctcgtggcggagaaccctctggagttgcacgaaggccgtggtccttcttcccaaccggaatcgggcgcgtccggccattacgagcaaccaagtatcgggtcccgccggccacgcccaacaaccccccgcgcccccattcg

SEQ ID NO: 36839 - protein, 34 aa, Zea mays
  misc_feature: Ceres CLONE 1421312-F
MGKGSVGASWWAFLLLAGVLLVEAATAGAEDGVV

SEQ ID NO: 36840 - DNA, 647 bp, Zea mays
  misc_feature: Ceres CLONE 1421317-F
  misc_feature: Encodes the peptide sequence at SEQ ID NO. 36841
aaagctggagctccccgcggtggcggccgctctagaactagtggatcccccgggctgcaggaattcgcacgagaccattacctagaacatcctaatcgaaaaactcctcatcgccacaagtgaagtcaccgacgcacgcacggctgcagcgcgctcctactctcccgcgaccgccaccggggaggggcaatagaatatagcgaggacagccaatgcaggccgccgtcaacaccaccactgtcggcgctcacccgcacccaacaaagtcctcgttcctccgtccatcccctccttgccgcgtctacttccacgcttctccacgcccgaaccatagggcgatcgccatggccagcaagtcgcagctgcaggagcaactgatcatcactcgccccaacgactggcacctccatcttcgcgaaggcggtgtcctcgaggctgtagtgccacacagcgcgaggcattttgggagggccatcatcatgcccaacctgaagccgccggtgaccacaacggcgcgggccatggagtacagggaggagataatgagggcgctgccgccagggagtagcttcgagccgctcatgacactatacctcacagacaacacaagcccagaggagatcaagctcgcaagaaagagtggtata

SEQ ID NO: 36841 - protein, 101 aa, Zea mays
  misc_feature: Ceres CLONE 1421317-F
  misc_feature: SWISSPROT Homolog: EC 3.5.2.3 Dihydroorotase
MASKSQLQEQLIITRPNDWHLHLREGGVLEAVVPHSARHFGRAIIMPNLKPPVTTTARAMEYREEIMRALPPGSSFEPLMTLYLTDNTSPEEIKLARKSGI

SEQ ID NO: 36842 - DNA, 676 bp, Zea mays
  misc_feature: Ceres CLONE 1421325-F
  misc_feature: SWISSPROT Homolog: EC 1.11.1.7 Peroxidase
  misc_feature (438)..(438): n is a, c, t, g, unknown, or other
  misc_feature (509)..(509): n is a, c, t, g, unknown, or other
aagctggagctccccgcggtggcggccgctctagaactagtggatcccccgggctgcaggaattcgcacgagaccattacctagaacatcctaatcgaaaaatccacaagaggagaagaaacaatcaaccagcaacactcttctcttataacatagtacagcgaaggtaactcacatggcaacttccatgggttgtctcgtcttgctctgccttgtttcttctctctcttcccagtgccctacttggacacccatgcggtggcttgttgccacagatgtatgacgattctcacatcaaggccaaggagattgagcataagttgtggaaaaggctgtcggaaaagacaccaggatggcggcatctttaatcagactgcatttccatgactggtttatccagggctgcgatgcttcggtgctggtgaacaacagcagcancatagttcgtgagaaatggtcccaaccgaacaggaaactccctcagggggttttgaggtggaaccaaccanaattaagggttgctcttgaaggttgccttggccaggggaaagtccttcttttgcccaactttgttgccccttggccgcttggtcaattccccccccccctggttgggttgggacaaaaactggggaaggggccacttttggcccgggaaaaaaatcccctacgtttt

SEQ ID NO: 36843 - DNA, 598 bp, Zea mays
  misc_feature: Ceres CLONE 1421329-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (361)..(361): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccacgcggtggcggccgctctagaactagtggatcccccgggctgcaggaattcgcacgagacattacctagaacatcctaatcgaaaattgatccctgaaaccatccacaattggtagctcgttgatccaaatccaaagactcacgtcaacgcactgtctcgcctggtaatagtcgtcgacgtcgtcgtctatgtccaggctgatggctgccatgctgcttcgaaggcncgcggcgtccccggccgcccaaaagctcacccggttaacgggaaacccttccttggaatggaaaggctctttcccatggccgggggggggtttctttttcccccccggcccccagggggaaggaaactggaaacccccccttttgttttttggaaggggggggccccaaaaaaattcccccccgggggaaaaaaaaaaaaaccccccccccgaaaaaaacccggggaaaaaaaaaaa

SEQ ID NO: 36844 - DNA, 659 bp, Zea mays
  misc_feature: Ceres CLONE 1421332-F
  misc_feature: Encodes the peptide sequence at SEQ ID NO. 36845
tggagctccccgcggtggcggccgctctagaactagtggatcccccgggctgcaggaattcgcacgagaccattacccagaacatcctaatcgaaaaatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtaagcagagcaccaacgaatgcttgcaattaatatttgaacacttctttccatatgcatgcgcgcgggcgtacgtacgtcattatgatgcgccggcgccgctcgcatccgcatcgcaagtggagaaccaccgcgtggacgcgccgcttattgaccaagtcaagcgcttcgtctacgggcactaccaagagcacctggaggccaagttctacgcctccgcccctcgccatgacctcgaagccgcccaccagaagtgacactgatgagaagccctcccacccaagtggactggggagtccaccttactttattcagcaccaccccaagacacaagttcccccaattctcagaaatctcaccc

SEQ ID NO: 36845 - protein, 46 aa, Zea mays
  misc_feature: Ceres CLONE 1421332-F
  misc_feature: SWISSPROT Homolog: EC 1.14.17.4 Aminocyclopropanecarboxylate oxidase
MEIPVIDLGGLNGGGEERSRTLAELHDACKDWGFFWVSRAPTNACN

SEQ ID NO: 36846 - DNA, 589 bp, Zea mays
  misc_feature: Ceres CLONE 1421334-F
  misc_feature (156)..(156): n is a, c, t, g, unknown, or other
  misc_feature (235)..(235): n is a, c, t, g, unknown, or other
  misc_feature (289)..(289): n is a, c, t, g, unknown, or other
  misc_feature (311)..(311): n is a, c, t, g, unknown, or other
  misc_feature (335)..(335): n is a, c, t, g, unknown, or other
  misc_feature (336)..(336): n is a, c, t, g, unknown, or other
  misc_feature (353)..(353): n is a, c, t, g, unknown, or other
ctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactggcactncggccggcggcaccgcgctcgcaggggctagccaacgagacggcagcaatgggcggacctgtgaccgcagcgggcatcntacggggcggcgcccacgcccactacgggcagcagcagcagcagggaagaagcnggctgcctgatggggtgagcanggtggaaagggcatgcctcccaannaacaaggggccccaacnggctttccccaggggctcttatacgggtggcaaacccttttttccccccttggggggggcttttcttccttggggtctttttcgggggtgttgggcctttaaaagccccccccctggtggggggggttttggccccctttaccccccccccccggggggtttttctaaaaaaatttcaaccccccccccgtgggggtgggcccccccccccccgcggtttttttttttaagggggg

SEQ ID NO: 36847 - DNA, 611 bp, Zea mays
  misc_feature: Ceres CLONE 1421336-F
  misc_feature: Encodes the peptide sequence at SEQ ID NO. 36848
ggagctccccgcggtggcggccgctctagaactagtggatcccccgggctgcaggaattcgcacgagaccattacctagaacatcctaatcaaaaacttttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggcccccgtgaggatgccacccgtatggttccccctgttgttgtgaaaaagcaggcccgggatatccccacccgaagggg

SEQ ID NO: 36848 - protein, 140 aa, Zea mays
  misc_feature: Ceres CLONE 1421336-F
  misc_feature (44)..(140): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRMVPPVVVKKQARDIPTRR

SEQ ID NO: 36849 - DNA, 592 bp, Zea mays
  misc_feature: Ceres CLONE 1421343-F
  misc_feature: Encodes the peptide sequence at SEQ ID NO. 36850
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (139)..(139): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttnnnnnnccaaactggnactccaccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggcgaccaagatattttccctccttatgctccttgctctttctgcatgtgttgctaacgcgacatttttccttcaatgctcacaagctcctatagcttccctttcttcccccatacctttccatcaatgaaggcttccgttatgggaaaccccactttctccaccctatggggtcccacaagcaatccccagccaaggaaaattccctttttccccccttgtttttaaaaaattccccagccccttattttttgggggcccccccctttgggggaaaaaaaacaccccccgg

SEQ ID NO: 36850 - protein, 43 aa, Zea mays
  misc_feature: Ceres CLONE 1421343-F
MATKIFSLLMLLALSACVANATFFLQCSQAPIASLSSPIPFHQ

SEQ ID NO: 36851 - DNA, 719 bp, Zea mays
  misc_feature: Ceres CLONE 1421352-F
  misc_feature: Encodes the peptide sequence at SEQ ID NO. 36852
aaagctggagctccccgcggtggcggccgctctagaactagtggatcccccgggctgcaggaattcgcacgagaccattccttaaacattcttattcaaaaatcgacccagccatctcctcaccctcgttcaccacacagtccgccactcctttagtagcttgtgatttgtacttccacgagatcactggtcgggtggcggacgactacacatggggaagggtagtgtgggtgcatcatggtgggcgttcctcctgctcgccggcgtgctgctggacgtaccagtcacggccggggcgaaagacagagtggtcgaacgggacccgaaggaggacctgtcatggtgcaagcacgcgtgcgagaggcagtacggaaaggacaccccgcgtgaatagggaatgcgagagcgagtgccgcgagcggcaccagctagctgacacaggctaggacggcgacagcagcgtggacccctacgtctccccgctcgggaggggcgagtggctgcgccagtgcctgcttctccaccagggcccggcgggggagacccagagggcatgaggggggggccgcccccgcggaatggcccgtcaacttggaacaagaaatccggtcccggcacccaaaacccgggcaattccccggataaggtgcaacgcccccccccccggggaactcggtgggagacgaacccctccctagaggaacttcaaaaacccggga

SEQ ID NO: 36852 - protein, 60 aa, Zea mays
  misc_feature: Ceres CLONE 1421352-F
MGKGSVGASWWAFLLLAGVLLDVPVTAGAKDRVVERDPKEDLSWCKHACERQYGKDTPRE

SEQ ID NO: 36853 - DNA, 705 bp, Zea mays
  misc_feature: Ceres CLONE 1421357-F
  misc_feature: Encodes the peptide sequence at SEQ ID NO. 36854
aaagctggagctccccgcggtggcggccgctctagaactagtggatcccccgggctgcaggaattctcacgagacctttacctataacatcctattcgaaaagacacatactggttgataatgggtgtgggtgctcaatggactctttgtgtcctctctcgtcatgctatagtgatcacggcgacttgctcttgagtcggttgtgcacccccgtcccacttaagttgtgtgccggatgtatttcatcctcagttccggctcttcatctcgtgtatcaacgtcagctcgcgtcctttgtactgaaaagtcgctcgattccgataatcttcatctttaacctcacttgttctatggccaccgttgttgagatttacataatggactaaccagacggcaaccttacaggtgatgatgcagaaatcatccctcgtgttgagagaaatggatctactccgattggactcaggatgttccaatgcccaaaagaaggggatgatcgaagcttataaggatctcagtgctaagtctctctttcctagcctgattgattacatcacttcaggcccttttgtgtgtatggattgcgcacgtgtcggcgtggtaactttggacacgaatctgatacggaaaacagatcctctatcagctcaaccagatagcattatggcgagatcttgctgctcacaccgtgaaggatctcgacgc

SEQ ID NO: 36854 - protein, 99 aa, Zea mays
  misc_feature: Ceres CLONE 1421357-F
  misc_feature: SWISSPROT Homolog: EC 2.7.4.6 Nucleoside-diphosphate kinase
MMQKSSLVLREMDLLRLDSGCSNAQKKGMIEAYKDLSAKSLFPSLIDYITSGPFVCMDCARVGVVTLDTNLIRKTDPLSAQPDSIMARSCCSHREGSRR

SEQ ID NO: 36855 - DNA, 668 bp, Zea mays
  misc_feature: Ceres CLONE 1421377-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (256)..(256): n is a, c, t, g, unknown, or other
  misc_feature (268)..(268): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaactgggactccaccgcggtggcggccgctctagaactagtggatcccccgggctgcaggaattcgcacgagaccattacctagaacatcctaatcgaaaaacccatattattgataccaactagcaacatacatagtggaagtacanctagcaacatcnttagcaccaatggggcagccaagattttttgccatcccttgcccctccttggctctttcagcaagcgttgctaccgcgactatttatcccacatgctcacaaacatacctctctcccggtgacagccgcgaggatttgaatacccaactattacaatcctacaaggctacaagaaggcccatcgcagccaagcattcttaacgggtcggttagcaatttgacccgtccaaacaaaccctttttggccccctatttgggcaaaccacccccccccccccttaaaaaggaaatccccattattcctctcccaaaaaaaaatggtgggggggcaaaaaaaatttttcaaaccaaaccccggttgtttttctccccccacaaatttttttcaccccgggggggg

SEQ ID NO: 36856 - DNA, 668 bp, Zea mays
  misc_feature: Ceres CLONE 1421379-F
  misc_feature: Encodes the peptide sequence at SEQ ID NO. 36857
  misc_feature (461)..(461): n is a, c, t, g, unknown, or other
  misc_feature (462)..(462): n is a, c, t, g, unknown, or other
agagctggagctccccgcggtggcggccgctctagaactagtggatcccccgggctgcaggaattcgcacgagaccattacctagaacatcctaatcgaaaacttttccagttgagttcacctcttggctcttgcctcctgcatctctagagaggcacatcccagctccaagcttcgcgccttgttggatcgtggcgtccaagcaacggtggtagcggagcgcgaggcagtggccgcagaaggaagcgcgaagcatccatggaccaacgccaggtggttagcgagaattatgccaatcccataacatgcttcttccatgtgctattcaaggcgggggcgctagccttctacatcctattctcgctctttgtgaagagcttcgtcatcatcttcgtgatcacggtgctcctcgcagcgcttgacttctgggtggtgaaagacgtcagtggcaggaatactanntcggctgcggtggtggatggagatcgatgatgacgaaacctggggtgggaagtttaaatgccttgagggggaatcctttccctcggaagaacagaaagatatcagggctttccggggggaacttttacttgaacggccgcgcaaggaacccctcggggaaattttcccccccaccggggtaggggtgaaacccccctgtggggggg

SEQ ID NO: 36857 - protein, 77 aa, Zea mays
  misc_feature: Ceres CLONE 1421379-F
  misc_feature (2)..(74): Pfam Name: DUF846 Pfam Description: Eukaryotic protein of unknown function (DUF846)
  misc_feature (68)..(68): Xaa is any aa, unknown, or other
MDQRQVVSENYANPITCFFHVLFKAGALAFYILFSLFVKSFVIIFVITVLLAALDFWVVKDVSGRNTXSAAVVDGDR

SEQ ID NO: 36858 - DNA, 728 bp, Zea mays
  misc_feature: Ceres CLONE 1421390-F
  misc_feature (688)..(688): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccattacctagaacatcctaatcgaaaaatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcatcgtggatccacatccggtcgctcctcgccgccgccgcgtcctcgtcctcgtcctcctccttcgcagcggctgcggctgggagcgcggtggctgtggtgtcggcaccggtggccgcctcgtcttcttcctcgccggcgtcgtcctcgccgcactcggagcggggtggtcttaaatctccatggtcccggagggaaaagaaacgagcactttctcgtgacagtgggagagtttgttttcagcaaatgggaagcttcgtgatgggtggaggaaaagttctcagaaaagtcgcagtggtggcattgaagcagcattnaggctgaaagttggcccttcctactnagagtctatgattt

SEQ ID NO: 36859 - DNA, 657 bp, Zea mays
  misc_feature: Ceres CLONE 1421396-F
aaagctggagctccccgcggtggcggccgctctagaactagtggatcccccgggctgcaggaattcgcacgagaccattacctagaacatcctaatcgaaaaatttcattcaccttacaaaacgcaccgctcctgaatatagagagtgtacacgtcccccccgccatcccacaccagctctggcggagatctcaccaagatacaggaccgtgtctcctcgacgccgcccgacatggcctacgcctgctctggacgcggctactttgtctaaacaccacggtgcccatatcatcttatcaatgaccatcgtgtccgcctgtccatggtcctccgatcccatgatctagacctagacgacctctactcacagtgggatcttcacatccagaagctgcggctgccgtgtccgtgatacagcgtcgaaaggggagctcccgctcaaggggagaccaattagagaacaaaccatggtcttgggaaagcctgggagctctgggtattgagggcccgcttttggctaccctttggagggggccatttcgaaacgggggagcccgggggaagggggagaggaagggcggctggggggggtggtgggggggcgggaaggggggaagggggggggggagtgggtcccgaggccaggggcagggtggg

SEQ ID NO: 36860 - DNA, 833 bp, Zea mays
  misc_feature: Ceres CLONE 1421396-R
accgggccccccctcgaggtcgacggtatcgataagcttttttttttttttttttggaaaagggctttaatatttcctgggaagccactaacatctgatatactactttgttactgaactatacctcataagaaatttaacagagggcaccaccaatgcatgggttgttaggggaacactgatgagtttgtcaaagcaagatggttgaatggcagcaaatgtaacattggtaaaagggtgccatcgttgtactcaaaatactggtggaacggcaacaactgaggttgtgtcaataaggtaccacggctcacaccatctaactggctgaatggtagtagttgctgctgctgtaaataagcatgagagttcaatgctgctagttggttgaatggaagaaactgctggctgtatgcatcaagtagcttgctgaatggtaacttggtgctgttgccaactagcagcagatgtcaatgcagctacttagttgaaacggcaaagaaatatctctccacaagatttcgcatcggggttcaccatgcacaactgggaacagccgatgggcccccaaggaacttttccaataattcccaaaaagggaaagggttgggattagccccattgtttctttgggggaaccccggttaaaaaaaggtgaaaatccccccccccggaaaaaaaattttaaaaacaggttgggaattcacaaataccttacccaaaaaaacccctttcggggctttttcgatataaaaccccagccgggataatttaaaaagggcacccggaaagggaacccccaattctttaaatggggacacgcaccaaacaccccc

SEQ ID NO: 36861 - DNA, 490 bp, Zea mays
  misc_feature: Ceres CLONE 1421404-F
  misc_feature (337)..(337): n is a, c, t, g, unknown, or other
  misc_feature (338)..(338): n is a, c, t, g, unknown, or other
  misc_feature (343)..(343): n is a, c, t, g, unknown, or other
  misc_feature (355)..(355): n is a, c, t, g, unknown, or other
  misc_feature (359)..(359): n is a, c, t, g, unknown, or other
aaagctggagctccccgcggtggcggccgctctagaactagtggatcccccgggctgcaggaattcgcacgagaccattacctagaacatcctaatcgaaaaattagttcagcacagcacatcttcctcgcagcgccggcgctccatcttccgctccctcccccaccttcgatcggcacgcaggctcggcgtcgtcgtcagcggttcctcctcccgcctctcgccagtagcctcgcgccctcggcgactggcgaccctgccttgaaggggctggcaagatgatcggcgtagggaaggagaagcaatacgccaacgtccttgactagcacctcatccnntgcanggcaggagacantttnagagcatttgcattctcgtgctctgagatggttcacaacaccccgactccagttgacaacattacttgaactggaaacgaaggctggaaaaacctggtaatccttttggggcaaggggggttggaacaatc

SEQ ID NO: 36862 - DNA, 556 bp, Zea mays
  misc_feature: Ceres CLONE 1421406-F
  misc_feature (264)..(264): n is a, c, t, g, unknown, or other
  misc_feature (269)..(269): n is a, c, t, g, unknown, or other
aaagctggagctccaccgcggtggcggccgctctagaactagtggatcccccgggctgcaggaattcgcacgagaccattacctagaacatcctaatcgaaaaaccaccactggggtcttcagaccattagctttatctactcgcagagcgcagaaagaaccctgatcgacaccatgagggtggttgctcgttgccctcgctctctggctctcgctgcgagcgcacctcacgcatacagcggcggctgcggctgccagcaccgnccgcngatcatctaccgccgccggtgcatcatgcacctcccgggtcacctgccacctccgggtgcattttccacccgccggtccacctgcccccccccggtccaccctggcaccgtcggtccatgttgccccgccggttcattttgccgccgccccatgccattaacttaattaaccggccggggttaaacttattccccgggcaaaacattgggccgggcaaaaaccccattcaaaaccccttccacttttgggaaacctcggggttggggacaccccccctcttgggccc

SEQ ID NO: 36863 - DNA, 637 bp, Zea mays
  misc_feature: Ceres CLONE 1421407-F
  misc_feature: Encodes the peptide sequence at SEQ ID NO. 36864
  misc_feature (637)..(637): n is a, c, t, g, unknown, or other
aaagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgn

SEQ ID NO: 36864 - protein, 158 aa, Zea mays
  misc_feature: Ceres CLONE 1421407-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEW

SEQ ID NO: 36865 - DNA, 661 bp, Zea mays
  misc_feature: Ceres CLONE 1421421-F
  misc_feature: Encodes the peptide sequence at SEQ ID NO. 36866
  misc_feature (661)..(661): n is a, c, t, g, unknown, or other
aagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaaggggtgggtgaagtggctcagtggcgtcatcgacaatgccctgtaccccgtcctcttcctggactacctcaagtccgccgtgcctgccctgggcn

SEQ ID NO: 36866 - protein, 140 aa, Zea mays
  misc_feature: Ceres CLONE 1421421-F
MGECRTEYRGLPDANGEDAGTVPAALRKVSIVPLVFLIFYEVSGGPFGIEDSVGAAGPLLAIVGFLVLPVIWSIPEALITAELGTMFPENGGYVVWVASALGPYWGFQQGVGEVAQWRHRQCPVPRPLPGLPQVRRACPG

SEQ ID NO: 36867 - DNA, 676 bp, Zea mays
  misc_feature: Ceres CLONE 1421425-F
  misc_feature (318)..(318): n is a, c, t, g, unknown, or other
  misc_feature (481)..(481): n is a, c, t, g, unknown, or other
aaagctggagctccccgcggtggcggccgctctagaactagtggatcccccgggctgcaggaattcgcacgagaccattacctagaacatcctaatcgaaaaatgtcttccgctccgctgcggcgctgactctggtgcggtgcgcgatgagcctttcccttgctgctggtaatccctaaacaacaaacactgagtgaacacaaccacccaatctgcatcgaagcaaagcttttctactatccaaatcgactcccttttctgttgcttccgatggacggtgctgcagctgcaggaggaagtagggaaccggcggccaancggttccaaacctgaggagcagcagtttgatcccagccgaatgatcgggatagttaaaaagaaagcctcaattaaaagacttggccaccggcataccatgcttaaatgaatagcatcctgtaaagaactcctgcagcttccaagaagtggggaggaggagcanccagttgaagccaaaatgcctgaagaaaccaagatccgttgggtttcaaacctccaagctttgggaagaagtaaattttggaaacttggttttttacttcctttcaaaaaaaacctttttgggccctgcccacccgccgggaattggtaccctaaaaaaaaaaaataaacccccgggaaaactttccctttaggg

SEQ ID NO: 36868 - DNA, 745 bp, Zea mays
  misc_feature: Ceres CLONE 1421428-F
  misc_feature: Encodes the peptide sequence at SEQ ID NO. 36869
aaagctggagctccccgcggtggcggccgctctataactagtggatcccccgggctgcaggaattcgcacgagaccattacctagaacatcctaatcacaatataaacgctgccctcccctttcgtaatccatgacttcactccccgacgcgtgcatggccagcgggacgaggctgcccctaggcctcctcccctcaaaaacgctgagcctctcccctctcccttctgcgcgtcgatccctctccatcgccgccgtggagccccggagctggctcctccgagccgccgctgaggaggcgcctgaggcccgggaggctgagctcgaggagcccgacgcggaggcggaggaggagcccgcggtaccggatcccgtagaggcgcagctcgccggcgctgtttctgataaggataacaacatcctcgctgttgcaatgatgggttcaaaacaatacattggaatgccgggccgggatatataccccccgagattggaagggggaaagggccatgggtccgaccataattaaacacggggctactggtcgtcaactagagaaaaatcttacattggcaacgacacgggggacccaacgctgcctgttcccgccgcggattaaaaaacggggaacgtcattgaaaaaagttatacgccctccggtcccacaaggaaaaacaaagtccccagaaggaacacgttggtccccaaccagccaaaacccagggttaaaagaaacccacgggcata

SEQ ID NO: 36869 - protein, 123 aa, Zea mays
  misc_feature: Ceres CLONE 1421428-F
MASGTRLPLGLLPSKTLSLSPLPSARRSLSIAAVEPRSWLLRAAAEEAPEAREAELEEPDAEAEEEPAVPDPVEAQLAGAVSDKDNNILAVAMMGSKQYIGMPGRDIYPPRLEGGKGHGSDHN

SEQ ID NO: 36870 - DNA, 644 bp, Zea mays
  misc_feature: Ceres CLONE 1421433-F
  misc_feature: Encodes the peptide sequence at SEQ ID NO. 36871
aaagctggagctccccgcggtggcggccgctctagatctagtggatcccccgggctgcaggaattcgcacgagaccattacctagaacatcctaatcgaaaatcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtgttcaccccgaccccgccgcctgcttctgtgaatgtcgcgcttcccgccgtgcaagtggcgcccccgcaatacgagaaggggttcgcggggggcaagcatgacgtatcggcgttcggctctctctgggaccccttcgcccgcgtcccagaagcccccccgagccctcaccaagtacctgtctacctggttccggttgggat

SEQ ID NO: 36871 - protein, 150 aa, Zea mays
  misc_feature: Ceres CLONE 1421433-F
MGSSSSPPPPPPLPLPMIGRAGNLTIFITPPSPASTPRGAGRTPPLESPRSDISTPIPQRAAPSPSLSPSPRNHESRAVAPAVVFTPTPPPASVNVALPAVQVAPPQYEKGFAGGKHDVSAFGSLWDPFARVPEAPPSPHQVPVYLVPVG

SEQ ID NO: 36872 - DNA, 694 bp, Zea mays
  misc_feature: Ceres CLONE 1421451-F
  misc_feature (694)..(694): n is a, c, t, g, unknown, or other
aaactggagctccccgcggtggcggccgctctataactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataccgcgagaaagcatgagccacttccccgccgcccgccgtgaagagcccccctcgccgtggccgcgccccgccgcccggcgaccccaaaaagccccgctctttcttggcccaagccggggcgcccccgcgggggccctgccggggccacccgggcgggtaacgcccgcttggaaccgcctcaacccccccctggtaaaaacacttggttttggggggagaaacagaggcccaccttatcccccttattttcgggggaaaaaaaaaagggaacccccacacctaggggggcccttttagggccacacctttcttctttaaaaaaacttcttaaataaccctacactttttccctcccctcccccccn

SEQ ID NO: 36873 - DNA, 616 bp, Zea mays
  misc_feature: Ceres CLONE 1421452-F
  misc_feature: Encodes the peptide sequence at SEQ ID NO. 36874
  misc_feature (445)..(445): n is a, c, t, g, unknown, or other
caaagctggagctccccgcggtggcggccgctctagaactagtggatcccccgggctgcaggaattcgcacgagaccattacctagaacatcctaatcgaaaaaattcacgcccccaccacgacttccgtgctcgccgccttctcggactaggggggttcggctcgagatctgatttcgggcgccggaggactacatggaggttagggagatggcgatggccgcggcggctgcggctgcggcgtccggcgggggaggcgtcaagctgccgccgcccaatcccaacctgccctacagggaggactgctggagcgacggcgagacggcagctctcgtctccgcctggggcagccgctacgtcgagctcaaccgcggtaacctgcgccagaagcagtggcaggaggtggcggacgccgtcaactcgcgccggggagcctccgcgcggnggcggcccggcgcgcaccggaaattcagttgccagaaaacccgcgtccaaaaaccccccttcaaaaaaaaaaaattaaaagggggggggaaatttttccccccccaaaagaggcccccccccccccccgggggggcctctttattctcccccccgggggggggtggggcgg

SEQ ID NO: 36874 - protein, 140 aa, Zea mays
  misc_feature: Ceres CLONE 1421452-F
  misc_feature (84)..(84): Xaa is any aa, unknown, or other
MEVREMAMAAAAAAAASGGGGVKLPPPNPNLPYREDCWSDGETAALVSAWGSRYVELNRGNLRQKQWQEVADAVNSRRGASARXRPGAHRKFSCQKTRVQKPPFKKKKLKGGGKFFPPQKRPPPPPGGASLFSPPGGGGA

SEQ ID NO: 36875 - DNA, 660 bp, Zea mays
  misc_feature: Ceres CLONE 1421456-F
  misc_feature: Encodes the peptide sequence at SEQ ID NO. 36876
aaagctggagctccccgcggtggcggccgctctagaactagtggatcccccgggctgcaggaattcgcacgagaccattacctagaacatcctaatcgaaaaaaaaaatatccgcgcgaccccgacctcccccctcccactccgggcagcagccagcagccagcaggcatggggatacccgtggtggttcccgtcgcggcggcctactcgtgctcctcctccctcgccgcgccaccgagggccgccgccgccgcggcgagggcgccgagccgcgcgcacgtcgcggcggccgggatgtcctccagggcgtcctccttcgtcgggggcagcggaggcgacctcgcggcggtggccgcgtcggtagccgcgcggcccaggagggcgggctccgggggaggcggcgcgctcgggtgcaagtgcctcttcgggctcggcgtgccggagctcgccgtcatcgccggcgtcgccgcgctcgtgttcgggcccaagcagctccccgagatcggccgcagcatccgcaagaccgtcaagagcttccagcagtaaaaattgttccgtgatccatcccactttctctcgcaggccggctaaggagtttgaaactgaactggagaaaagagcctgggggaaggcggcgatcagcccccaacctgcaacctt

SEQ ID NO: 36876 - protein, 125 aa, Zea mays
  misc_feature: Ceres CLONE 1421456-F
  misc_feature (88)..(126): Pfam Name: MttA_Hcf106 Pfam Description: mttA/Hcf106 family
MGIPVVVPVAAAYSCSSSLAAPPRAAAAAARAPSRAHVAAAGMSSRASSFVGGSGGDLAAVAASVAARPRRAGSGGGGALGCKCLFGLGVPELAVIAGVAALVFGPKQLPEIGRSIRKTVKSFQQ

SEQ ID NO: 36877 - DNA, 634 bp, Zea mays
  misc_feature: Ceres CLONE 1421458-F
  misc_feature: Encodes the peptide sequence at SEQ ID NO. 36878
  misc_feature (335)..(335): n is a, c, t, g, unknown, or other
  misc_feature (355)..(355): n is a, c, t, g, unknown, or other
aagctggagctccccgcggtggcggccgctctagaactagtggatcccccgggctgcaggaattcgcacgagaccattacctagaacatcctaatcgaaaaaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacnggcgcacgcttgctgactancacatccagaaagagagcaccctccaccttgtgctccgtctcaggggaggcatgcagatctttgtgaaaacccctgaccgcaagactatcacccctcaagtgaagccctctgaaaccattgacaacgtcaaggccagaatccaggaaaaagaggggattcctcccaaacaaggagggggttcattctttgttggggaacaactttggggaaggggcccacctttgccaacttcaaaaatccagaaaggagaccccccctccccttgggggcggggcccc

SEQ ID NO: 36878 - protein, 152 aa, Zea mays
  misc_feature: Ceres CLONE 1421458-F
  misc_feature (6)..(74): Pfam Name: ubiquitin Pfam Description: Ubiquitin family
  misc_feature (53)..(53): Xaa is any aa, unknown, or other
  misc_feature (59)..(59): Xaa is any aa, unknown, or other
MQIFVKTLTGKTITLEVESSDTIDNVKAKIQDKEGIPPDQQRLIFAGKQLEDXRTLADXHIQKESTLHLVLRLRGGMQIFVKTPDRKTITPQVKPSETIDNVKARIQEKEGIPPKQGGGSFFVGEQLWGRGPPLPTSKIQKGDPPSPWGRGP

SEQ ID NO: 36879 - DNA, 652 bp, Zea mays
  misc_feature: Ceres CLONE 1421461-F
  misc_feature: Encodes the peptide sequence at SEQ ID NO. 36880
  misc_feature (628)..(628): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcacccgatgggtgagcaggtgaagggcatgctccacgacaaggggccgacggcgtcgcaggcgctgacggtggcgactctgttcccgctgggcgggctgctgctggtgctgtccgggctggcgctgacagcctccgtggtggggctggccgtggccacaccagtgttcctgatcttcagccccgtgctggtccccgccgcgctgctcatcgggactgccgtcatggagatcctcacgtcgggcgcgctggggctcgggggcctagtctcactcacgtgcctacgcaacacggggcggcaggcgttacagcgcacccccggactacatggaaggagcgcaccnctagatggctggaggcagcgtgca

SEQ ID NO: 36880 - protein, 149 aa, Zea mays
  misc_feature: Ceres CLONE 1421461-F
  misc_feature (44)..(149): Pfam Name: Oleosin Pfam Description: Oleosin
MADRDRSGIYGGAHATYGQQQQQGGGGHPMGEQVKGMLHDKGPTASQALTVATLFPLGGLLLVLSGLALTASVVGLAVATPVFLIFSPVLVPAALLIGTAVMEILTSGALGLGGLVSLTCLRNTGRQALQRTPGLHGRSAPLDGWRQRA

SEQ ID NO: 36881 - DNA, 811 bp, Zea mays
  misc_feature: Ceres CLONE 1421466-F
  misc_feature (30)..(30): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (89)..(89): n is a, c, t, g, unknown, or other
gccccccgcgtccctccctccccgcggcgnctccttttcatcgccgctaccgcccccggtgcccaggnnnnnnannnnccaaaactggnactccccgcggtggcggccgctctatatacagtggatcccccgggctgcaggaattttcacgagaccattacctagaacatcctaatcgaaaaacaaacttcccctgtcacgagtagtacgagaccacgccttctgtgggatcaatcggctagggtttcggagatgttcggccgcgcgccgaagaagagcgacaacacccggtactacgagatcctgggggtttccaaggacgcgtcacaggatgacctctagaagggctaccgcaagggcgccttcaagaaccaccccgacaagggcggcgaccccgagaagttcaaggagctagctcaggcttatgaagggcctcagcgaccctgagaagacgagagatctatgacccgggatgggccaggaagcccccctaggaagggaatgggaagcgcggtggctgggaaggccagcacccccttcggaacccactcccaagtccatccatttgggtggtaggagaggccccctcgggaaaaccgagcccgccccactcggcgcaagaaaggacaacggacggcgcgacaaggcagtggctctccaccactcctccaggcgtttccccacggcagcatccttgtacccccggtccaccaccccaacaaacgccctccattcagtgcccaccccagggcggccactcgtgcgtcccaagtgccgagatggacacaatggaacgctcaggcatcccaca

SEQ ID NO: 36882 - DNA, 709 bp, Zea mays
  misc_feature: Ceres CLONE 1421470-F
  misc_feature: Translation starting site: 360
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaaatgtagctctttctggtcccaggagaacgagccgctcgctgatgtgggagcttgtcagcaccgtggatcgcccaaacggccagacgtgatgtctcgcccacgtgtcccttgcccctgtccacctgtcccctccggagcctgcaaagaactcccctccccgctatcatttccggcgcagaaaaggagagtaacactcaacactgcagaaatcagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctgggagctgtacaaggacacggcaacgccggggcggcctgcctcgcgtggccatcgcgcacaccctggcgcttgtggccgcggtggcngtagcaagcaacccgtcgggtgggcacgtcaaccctgcggtcacgttcggcctgctcgtgggccggcccatcttcttcggggcgtgcccgcgtatactggctcccgcaattctccgcc

SEQ ID NO: 36883 - DNA, 640 bp, Zea mays
  misc_feature: Ceres CLONE 1421479-F
  misc_feature: Encodes the peptide sequence at SEQ ID NO. 36884
aaagctggagctccccgcggtggcggccgctctagaactagtggatcccccgggctgcaggaattcgcacgagaccattacctagaacatcctaatcgaaaaatcaccaagttgttggattccagcagcggcgcccccaggccaggccccacccggtcagcctgcctcagctgcccaaccttctccccatctgctcagcctcagctgtcattcccgcgaagcgccgtctcccggctctatcgatggaccgagacgccgccctcgtcgtcgcgctcctcgccctcttcttcgccgccggggccacggagcatgccccgggctcgtcacccaagcgcactccagcgacagcgccacccaggacggacttcctcccgccgccgcacggccagggcgcctatggcctcaccgccctcgacacccgagatggcgccggtgccctctccctcaggcggagtgccggacacgagccccgtcggcgcgggagctggtgacgacgctatggcacccgccggagccgcggcggctctgactccggatgccgcgccagtcacggagaagagcgacgccggctcagcctccgaacgcgccgccagccgtagtgatcatcggtgaccgcgatgccagacgccgatcgcgttct

SEQ ID NO: 36884 - protein, 71 aa, Zea mays
  misc_feature: Ceres CLONE 1421479-F
MASPPSTPEMAPVPSPSGGVPDTSPVGAGAGDDAMAPAGAAAALTPDAAPVTEKSDAGSASERAASRSDHR

SEQ ID NO: 36885 - DNA, 642 bp, Zea mays
  misc_feature: Ceres CLONE 1421485-F
  misc_feature: Encodes the peptide sequence at SEQ ID NO. 36886
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaaaaactcaccctgcagccgccacctcatgaccctgcagcaccctcaggcctcaccgcctcagctgccaccctcaccctgcatccgagagagagagagaggagagttgccgccggagggaggaggtcgccgcggaggggaggggctcgccggtaggggacatcgccggcgcctggagagctcgtggaggggacagccaccgtcaccgccaggagacaagcgccgccgccgctaggaatcaggagacaagcgagcgcgatggtgagctccgcactgaggcgctgtctcccctgccatgcctctctctgtcatgccttccctccccatccgctgctggccgctgccggcgtcttccgtcgttcattccagtccggggatggtgagactatggacgaattcgaagaacggttgtttgggggcaaggacacagacaaaggatcactctacgagaagctcgatagggctgagaacactgcgacaggagcagttcaggatggatggatggttatgattcttttaatgatggcttaaatgatancattg

SEQ ID NO: 36886 - protein, 90 aa, Zea mays; identical to SEQ ID NO: 23867
  misc_feature: Ceres CLONE 1421485-F

SEQ ID NO: 36887 - DNA, 651 bp, Zea mays
  misc_feature: Ceres CLONE 1421490-F
  misc_feature: Encodes the peptide sequence at SEQ ID NO. 36888
aaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaagcatccggagtagtagagagtgtcggtgaaggtgtgaccgagttcaagtcggtgacacgttctcactgtcttcattggggatgcaagagctgcaagcactgcgtctcaggaagagcaacatgtg

SEQ ID NO: 36888 - protein, 66 aa, Zea mays; identical to SEQ ID NO: 22274
  misc_feature: Ceres CLONE 1421490-F
  misc_feature: SWISSPROT Homolog: EC 1.1.1.1 Alcohol dehydrogenase

SEQ ID NO: 36889 - DNA, 733 bp, Zea mays
  misc_feature: Ceres CLONE 1421493-F
  misc_feature: Translation starting site: 143
aagctggagctccccgcggtggcggccgctctagaactagtggatcccccgggctgcaggaattcgcacgagaccattacctagaacatcctaatcgaaaaattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcacttcgtggagccccagatcctggaggccgtgggcgtcgactacgtggacgagagcgaggtgctgacccccgccgacgacgcgcaccacatcaacaagcacaactttcgcgtcccctttcgtctgcggctgccgcgacctcggcgaggcgctccgcagggtgcgcgaaggccccgccatgatccgcaccagggggaggccggcacggcaaactcttcaagccgtgcgccacttgcgctccgtcatgggcgactccccccgctc

SEQ ID NO: 36890 - DNA, 762 bp, Zea mays
  misc_feature: Ceres CLONE 1421495-F
  misc_feature: Encodes the peptide sequence at SEQ ID NO. 36891
ctggagctccccgcggtggcggccgctctagaactagtggatcccccgggctgcaggaattcgcacgagaccattacctagaacatcctaatcgaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctgggccatgaccttcgggctcgcctgctgcgcggtggagatgatgcaccgccggcgcgtcccgctacgacttcgaccggttcggcgtcattcttccgtcggtcgccgccccagtccaatggatggacgttccccggccacctccccaaacaagatggctcccgcccctccgcagggtttataaccaaatgcctggaccctaggggggttatttcaatgggcccctttgccccaacgggggggggaaccaaccatttcccccacccttgtgggaccgggaatggaacccataaccccccgggggaaacttcccgtccccggggggcccccacaactggtggaggccccttttttagggggtttctccccccccaaaaaaaaataaaccggggggtt

SEQ ID NO: 36891 - protein, 84 aa, Zea mays
  misc_feature: Ceres CLONE 1421495-F
  misc_feature: SWISSPROT Homolog: EC 1.6.5.3 NADH dehydrogenase (ubiquinone)
MSKTAEFVVSKVDDLMNWARKGSIWAMTFGLACCAVEMMHRRRVPLRLRPVRRHSSVGRRPSPMDGRSPATSPNKMAPAPPQGL

SEQ ID NO: 36892 - DNA, 644 bp, Zea mays
  misc_feature: Ceres CLONE 1421497-F
  misc_feature: Translation starting site: 155
  misc_feature: SWISSPROT Homolog: EC 5.2.1.8 Peptidylprolyl isomerase
  misc_feature (264)..(264): n is a, c, t, g, unknown, or other
  misc_feature (265)..(265): n is a, c, t, g, unknown, or other
  misc_feature (323)..(323): n is a, c, t, g, unknown, or other
  misc_feature (329)..(329): n is a, c, t, g, unknown, or other
  misc_feature (363)..(363): n is a, c, t, g, unknown, or other
aagctggagctccccgcggtggcggccgctctagaactagtggatcccccgggctgcaggaattcgcacgagaccattacctagaacatcctaatcgaaaatagcagaattctctcaacctcatcggcggcggcgaagagcgtgcggatcggagatggcgacaagcgggtggaggaggagagcggcggcgcgggcctcctggcgccccgccacggtgtacctgtggctcgcgctcgccgcagcagcactgacgctcgcccaggnnctagaggaccctacgggaggtaccccacaggtctacttcgatgtcgagattgacggcnagcccngcaggtcggattgtcatggggcttttttgggaangactgttcctaaagacagcagagaactttccgagctctttgccccgggagaaaaaagaaatttgccagaattggcaaagcctcccccccttccaaggggaaggtcctttcccccgaaaatccttcccaggctttctttgcccccaaggggggggaccttcccctccttggggaaatgggaaggggggggggagaacctattcttttggggctaggaattttgccttaattaaaaaacctttcaaaattaaagccccccctggggaccggggcgcctttttg

SEQ ID NO: 36893 - DNA, 485 bp, Zea mays
  misc_feature: Ceres CLONE 1421499-F
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (429)..(429): n is a, c, t, g, unknown, or other
aagctggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgccctgatttgattggggtgcccccgggttccccaggcaatgggggggggccccagggggccctttttttccccccccccccttttccccccggggggggggggggcccccttttttttccccaaagaggggaaccccccccgggggggggccccttttnnnnttttttcttttaaaaaaaaggtttttttttccccccccccccccaaaaaaaaaaaaacantgttgttgtgtggggggggaaaaaaaaatattttttttttgggggggggggggggg

SEQ ID NO: 36894 - DNA, 727 bp, Zea mays
  misc_feature: Ceres CLONE 1421501-F
  misc_feature: Translation starting site: 430
  misc_feature: SWISSPROT Homolog: EC 2.4.1.238 Anthocyanin 3'-O-beta-glucosyltransferase
aagctggagctccccgcggtggcggccgctctagaactagtggatcccccgggctgcaggaattcgcacgagaccattacctagaacatcctaatcgaaaaatcataaaaaaaagacaccctgcgtcatttaccgaccaccgtccatccatggatgcagccgagggccgaggggcagagtgggccgaggggcgtggcaggcggtgagcacgccggtggtcgggacggtacggatctcgtgatccatggccttcgcgggatggcgctgctccctgcttatgacacctcccgttcaccggcagcgaatcggggcttggcatttcccatcaagcattaagcagtgaagcaccccccctcgtttccaccggcagtccggcagcgagcagacagtaacagaatcaggcggtgtcttggaaataacttcagtgccatggcctggtctcatggaacatctccattatttccagtttacaagcttgagcagatcctgatgcgaggaccctccatctgtgatactctcgcacgctgctctcttcaaagaaagtgccctcgctctgatcgtatcatcagcgagcagctggttgactttgtccctgatctcctccttggtgaagacgccccgctcgttggcacggatcctcaagcccgtgccccacacgtcgcagatgtacttctggttcaagaactggtcggcaaagtatggccaacacaggaacgggacgccgtga

SEQ ID NO: 36895 - DNA, 893 bp, Zea mays
  misc_feature: Ceres CLONE 1421504-F
  misc_feature: SWISSPROT Homolog: EC 3.1.2.15 Ubiquitin thiolesterase
  misc_feature (43)..(43): n is a, c, t, g, unknown, or other
  misc_feature (46)..(46): n is a, c, t, g, unknown, or other
  misc_feature (408)..(408): n is a, c, t, g, unknown, or other
  misc_feature (430)..(430): n is a, c, t, g, unknown, or other
  misc_feature (526)..(526): n is a, c, t, g, unknown, or other
  misc_feature (564)..(564): n is a, c, t, g, unknown, or other
  misc_feature (613)..(613): n is a, c, t, g, unknown, or other
  misc_feature (663)..(663): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (684)..(684): n is a, c, t, g, unknown, or other
  misc_feature (715)..(715): n is a, c, t, g, unknown, or other
  misc_feature (736)..(736): n is a, c, t, g, unknown, or other
  misc_feature (754)..(754): n is a, c, t, g, unknown, or other
  misc_feature (789)..(789): n is a, c, t, g, unknown, or other
  misc_feature (837)..(837): n is a, c, t, g, unknown, or other
  misc_feature (853)..(853): n is a, c, t, g, unknown, or other
ggccccccctggtaaaaatctgtagcgccgggggtgtgtgtcnggngaatcaaggtggagctccccgcggggggggccgctctagacccgtagatcccccgggctgcaggatattgccctacacctttacgaaaaacttcataatgaaaaaactggagaccgtgagctttttcctttttccggtttcaagtttgttgttgaagagagggttcactgaccttttgggaaggtttcttacaacaaacgatctgacaacgttctttctttgagcataccactggatgaggtaactaataaagaggagctaggagtttttactgagaagaaaggtgcaatgaactttggatggaaaaaagacgtgtctaatggaggatattggtcagggcctagcagtcccctttggagggnttgcctggcgaaagtttttttntgggcccgtaagaggatttcggggaggggtgaggggaggtgagttttaaattgcgaggggagtagccgcccccttaaaaaaacgccgggcctcccnctaaacattttccgtcgtttgtgctgtgtcggcggggnagtttgcgctaaagtttcttccgcgggtgtgacacgaagcggggtgtcncaaatggaaaacccacgcatgtcattatttccgggtggggggcgaaatcnaaatggtgtgttgggnnnnanagattgtgctccagacaaagggtatcacggntctgtggggcgaaagagggtntctttcggagaatagggntttcctggcagagaaaatagatgatcgtgccccgnatattccgcggctgccaccgcgggcagatatagcggaccccagacggnccaagcgaggagccangtaatgcgccatcctctttgagtagaaggcgtatattaac

SEQ ID NO: 36896 - DNA, 651 bp, Zea mays
  misc_feature: Ceres CLONE 1421507-F
  misc_feature: Encodes the peptide sequence at SEQ ID NO. 36897
aaagctggagctccccgcggtggcggccgctctagaactagtggatcccccgggctgcaggaattcgcacgagaccattacctagaacatcctaatcgaaaaacaatcacaagccaccgctactccaccaaaccgcacggaggcggaacccaaattccaacccgactcctccagccaacagcccaagcgaagcgagggcccttgagctcccctcccgcatgacgtccccaaggtgcctctcggcaccgcccgccgccccgcccgtggcggctgcgcccggcgccctcggcttctccgcgtctgcctccaccctcgcgcgtgtgccggttcccggaagtaggcggcgcaggtggaacgcgctcgtggtctgcgcggcccccgatgaggagaagattacgaagcggtcgcccctggatttccccatcgaatgggagagacccaaacctgggaggagacctgatatcttccctaaagtcagcccaatgaagacaccattaccgcatccattgccagctgatgatcctctggatgatgatgaagaggaagaggaagaacaagcaccacctcagggagagccacaagaagacgatccagacaaggaagaacctgaagaagatgacccagaaagcccacccgagtattttcgattgg

SEQ ID NO: 36897 - protein, 144 aa, Zea mays
  misc_feature: Ceres CLONE 1421507-F
MTSPRCLSAPPAAPPVAAAPGALGFSASASTLARVPVPGSRRRRWNALVVCAAPDEEKITKRSPLDFPIEWERPKPGRRPDIFPKVSPMKTPLPHPLPADDPLDDDEEEEEEQAPPQGEPQEDDPDKEEPEEDDPESPPEYFRL

SEQ ID NO: 36898 - DNA, 703 bp, Zea mays
  misc_feature: Ceres CLONE 1421508-F
  misc_feature: Encodes the peptide sequence at SEQ ID NO. 36899
  misc_feature (572)..(572): n is a, c, t, g, unknown, or other
tggagctccccgcggtggcggccgctctagaactagtggatcccccgggctgcaggaattcgcacgagaccattacctagaacatcctaatcgaaaacaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttcccattcaccaactgtctacactgaaccctgctgcttaattgcagncacaactattaccatttagccagctagctactggctactctcagcaacaaccacttcctccaattaaacaatttggccgcactgaaccccgctgcttatttgcagcagcaaatactactaccatttagccg

SEQ ID NO: 36899 - protein, 133 aa, Zea mays
  misc_feature: Ceres CLONE 1421508-F
MATKIFSLLMLLALSTCVANATIFPQCSQAPIASLLPPYLPSIIASICENPALQPYRLQQAIAASNIPLSPLLFQQSPALSLVQSLVQTIRAQQLQQLVLPLINQVALANLSPYSQQQQFLPIHQLSTLNPAA

SEQ ID NO: 36900 - DNA, 904 bp, Zea mays
  misc_feature: Ceres CLONE 1421514-F
  misc_feature: Encodes the peptide sequence at SEQ ID NO. 36901
  misc_feature (18)..(18): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
ggggggggggttttttcnttttaggaccgtcccgtcgccccgcccccgcgtccgggggcaggggggggnnngtcccccttcaaagctggtgctccaccgcggtggcggccgctctagaactagtggatcccccgggctgcaggaattcgcacgagaccattacctagaacatcctaatcgaaaaaaaaacctaaacctagcttttcgtcagtacaacgcctccgccgctccttccattagctcagacatggttctcggcctctacaccttcgccgacatcgacgccgacggagcaccccgcctcgaggttgccgatggcgaggagttcgtccgtgtcgatcgcgttgtccagcttgccctcggtccccgggtgctgaaggcccctggaaccctttacctcaccacccaggagggtggatttggggtcatgcgatgtgcggcgaaggggcttacgctgtgcggactcccgtttgtccctccttcgatccctcgcccgcggcgcagcggtgagttcctgaagggggggtaacccccatcacaccccctggcattccttgctcacataacatatcgaattagcgcgcgaaccgcctattttttcccggtaatggtaggggagagtgtggtgtatccgcgcgccccaccatgtttttcgccacaaccccgctgtgggcaggaatccttccgcgggattcttccctagacggccggacggggtaaattggggcggagtgagtcttaccctgccctgatcttcttggcgtatcacatgggacattgaaacgtcccctgttgaaagacaagtctcggttaaatttgagcggttggaggctggaaagcccatggtcgcctatactggcttgggctgagccactccaactgaattatgggttgcggcctcctg

SEQ ID NO: 36901 - protein, 93 aa, Zea mays
  misc_feature: Ceres CLONE 1421514-F
MVLGLYTFADIDADGAPRLEVADGEEFVRVDRVVQLALGPRVLKAPGTLYLTTQEGGFGVMRCAAKGLTLCGLPFVPPSIPRPRRSGEFLKGG

SEQ ID NO: 36902 - DNA, 632 bp, Zea mays
  misc_feature: Ceres CLONE 1421515-F
  misc_feature (625)..(625): n is a, c, t, g, unknown, or other
ctggagctccccgcggtggcggccgctctagaactagtggatcccccgggctgcaggaattcgcacgagaccattacctagaacatcctaatcgaaaactgtgtcttgtccagtccgggtctccagggctccggcaccggcaggcagagagctaccaaaccccaccaccacgaacggccgccgccgacgagacgggggcgcatggcgactgcatcctccttcaccgccatcttcttcagcagcgccttcgcggcctgcttcgcggagccaaagtgcggctccagctgcaaaggaaggcaccactaccgtcgccaccagtggctgcagcagctgctgctggaggcacgctagccacaatcatgtgcatcgccagggaggaaggggttgccgcgctctggaagggcgtcatccccggcctccaccgtcagttcctctatggcggcctccgcatcggcttgtatgagcctgtgaaggctttcttcgtcggaggcgctgttgtgggtgatgtcagtttactaagcaagatccttgctgcacttaccacaggtgtgatagcgattggtgtggcaatccaactgatcttgtcaaagttaggttgcaagctgatggaaaagctaacactatncagagga

SEQ ID NO: 36903 - DNA, 664 bp, Zea mays
  misc_feature: Ceres CLONE 1421516-F
  misc_feature: Encodes the peptide sequence at SEQ ID NO. 36904
aagctggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacggtgggcttcttctggctggtgaacccacgcgtggcggaagagctgatgggcggcatgctcccgcgggtggcccagtttcacaagggccccctgggaaggaaaaaaagggcccttccctcccggggacctgggttccaaaaaccgggggtttttccccccaaaattaaacaccccttttaaaaggggcccgccgcgccccaaaaattgcgggccaccacccccttctttttgtt

SEQ ID NO: 36904 - protein, 154 aa, Zea mays
  misc_feature: Ceres CLONE 1421516-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNPRVAEELMGGMLPRVAQFHKGPLGRKKRALPSRGPGFQKPGVFPPKIKHPF

SEQ ID NO: 36905 - DNA, 729 bp, Zea mays
  misc_feature: Ceres CLONE 1421518-F
  misc_feature: Translation starting site: 207
  misc_feature: SWISSPROT Homolog: EC 2.5.1.47 Cysteine synthase
  misc_feature (411)..(411): n is a, c, t, g, unknown, or other
  misc_feature (439)..(439): n is a, c, t, g, unknown, or other
  misc_feature (479)..(479): n is a, c, t, g, unknown, or other
aaagctggagctccccgcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccangcgtgagtgttctgattgaacaactagncgcaacacaggcattggactggcccttatggctgctgccnagggctacaaacttacactcacaatggctgcctccatgagcatggagaggaagattcatatgaagcttttgggggctgaacttgccctactgacccactccggggatggaaaggacttgcaaaaaaccgaaaaaatccaggaaaaacccccactttttactcctttaaaattttgaaatccggcttacccaagatccctttgaaccccctgccccgaaatcgggaagccccccgggaaaaattgggcctt

SEQ ID NO: 36906 - DNA, 645 bp, Zea mays
  misc_feature: Ceres CLONE 1421527-F
  misc_feature: Encodes the peptide sequence at SEQ ID NO. 36907
  misc_feature (621)..(621): n is a, c, t, g, unknown, or other
ggagctccccgcggtggcggccgctctagaactagtggatcccccgggctgcaggaattcgcacgagaccattacctagaacatcctaatcgaaaaactcacagctcaaaagcagccaaaacgctagctagctgcagcgatgatgtctcgctcctgctgcctcgccgtgtcggtccttctcgcggtcgccgcgacagccagcggcgccatcgcgccggcgttgctgcacgaggggcgcctcgaggaggagggactgctggtcgcggagggcgcgagggtggcgtccacctgggcgggcaacaaggtctcgcgggcgcagccgatggaggcgtggccgagcggcggcgtggccacgcagggcgacgaccagagctcgtcgggcggcggcgagcacgccaaggaggaagggagcagcaaggagggcgagaagcagggcaggagctgcctcaccaaggaggagtgccacaagaagaaggtgctctgcggcaaggcctgcacgctctcggcgcacagcaagtgcgccgcccagtgcaccaagtcctgtgtccctacctgctaggacccgccgacgaggaagctagtttctgtgatgcatttgcaagatgattggaataagacggntacttcttgcatgcatgcctctgg

SEQ ID NO: 36907 - protein, 139 aa, Zea mays
  misc_feature: Ceres CLONE 1421527-F
MMSRSCCLAVSVLLAVAATASGAIAPALLHEGRLEEEGLLVAEGARVASTWAGNKVSRAQPMEAWPSGGVATQGDDQSSSGGGEHAKEEGSSKEGEKQGRSCLTKEECHKKKVLCGKACTLSAHSKCAAQCTKSCVPTC

SEQ ID NO: 36908 - DNA, 671 bp, Zea mays
  misc_feature: Ceres CLONE 1421536-F
  misc_feature (37)..(37): n is a, c, t, g, unknown, or other
  misc_feature (50)..(50): n is a, c, t, g, unknown, or other
  misc_feature (51)..(51): n is a, c, t, g, unknown, or other
  misc_feature (60)..(60): n is a, c, t, g, unknown, or other
  misc_feature (81)..(81): n is a, c, t, g, unknown, or other
  misc_feature (87)..(87): n is a, c, t, g, unknown, or other
  misc_feature (88)..(88): n is a, c, t, g, unknown, or other
tggagctccaccgcggtggcggcccgctctagaactnagtggatcccccnngggctgcanggaaattcgcacgaagaccanttaccnntagaacatcctaatcagaaaaacattctcctcagatccactcgcaagacgccgccgtccgctaccatcccgtgcgcctgccggaagcactcgcatatggcctgccgtccgcactcggaacgcacaggcactctacgacggagacacgccatcaccgactcccgcatctcagacgcgcgactccagcctagccaggtggtcgctcttagctctcccctgattcatccatgcgtccgggccctaccaccttgcgtctcaggcgatggcggcgtcggctctcacccccggtagcgcagccggctcggtgcgcgtgcctggcgggctatgacctccggagatgcgggacaacgctggacaaggacgtaagatccaccaaggtggtgctgtacatgagaggtcaccaaggacttcccgcagtgcggcttctccaacaccgtcgagtagatcctgcgctagatctacttgcccttcgacacgctcgatgtgctcaccaacgacgcgctccgggaggtgctcaaggagtactccagctggtacaccttcccgcagctctacatcgacggggagtacttcagtggatgtta

SEQ ID NO: 36909 - DNA, 723 bp, Zea mays
  misc_feature: Ceres CLONE 1421537-F
  misc_feature: Encodes the peptide sequence at SEQ ID NO. 36910
aaagctggagctccccgcggtggcggccgctctagaactagtggatcccccgggctgcaggaattcgcacgagaccattacctagaacatcctaatcgaaaagttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattcggaaaacttcacggtcgagaactctgttctgttcgctggtccg

SEQ ID NO: 36910 - protein, 159 aa, Zea mays
  misc_feature: Ceres CLONE 1421537-F
  misc_feature (58)..(159): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEISQTIDSENFTVENSVLFAGP

SEQ ID NO: 36911 - DNA, 725 bp, Zea mays
  misc_feature: Ceres CLONE 1421544-F
  misc_feature: Encodes the peptide sequence at SEQ ID NO. 36912
aaagctggagctccccgcggtggcggccgctctagaactagtggatcccccgggctgcaggaattcgcacgagaccattacctagaacatcctaatcgaaaagtctgtctgtctgcctccctccgctcacatcctctgcttcttctcgctttcttccatcttggtccagcctccactcttcctgctgagccatggcggctgccgaagaagggccagagccactcaggtatcagactctggccctgagggtgagcatccactgcgagggttgcaagaagaacgtgaagaaggtgctccacagcatagaaggggtgtacaagacggacatagacacgcatcagcagaaggtggtggtcataggcaacgtctctgcacacgcgctcgtcaagaacctcctcaagtccgggaagcacgcggagccgtggccggagcctgctccagccccaccggccgccgacagcccgcccgggcccgacggatctcccggcagcgcaggcaagaagaagaaaaataagaatggcaacaagagccccgaggcggcgaacaacaagcccgcctatccggcgccagcgcccgcgcccgcgccggcatagggcaacggcggacccaacccctcggagcagcacgacaaggctgacggcggcgcctcatgcgatgaggcatctgatggtgagcacgataagcctgatgctggcggtggcggcggcaacggctcccctgacgac

SEQ ID NO: 36912 - protein, 133 aa, Zea mays
  misc_feature: Ceres CLONE 1421544-F
  misc_feature (17)..(77): Pfam Name: HMA Pfam Description: Heavy-metal-associated domain
MAAAEEGPEPLRYQTLALRVSIHCEGCKKNVKKVLHSIEGVYKTDIDTHQQKVVVIGNVSAHALVKNLLKSGKHAEPWPEPAPAPPAADSPPGPDGSPGSAGKKKKNKNGNKSPEAANNKPAYPAPAPAPAPA

SEQ ID NO: 36913 - DNA, 643 bp, Zea mays
  misc_feature: Ceres CLONE 1421545-F
  misc_feature: Encodes the peptide sequence at SEQ ID NO. 36914
agagctggagctccccgcggtggcggccgctctagaactagtggatcccccgggctgcaggaattcgcacgagaccattacctagaacatcctaatcgaaaaaaaatcttccaagtcaccaacgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgg

SEQ ID NO: 36914 - protein, 155 aa, Zea mays
  misc_feature: Ceres CLONE 1421545-F
  misc_feature (34)..(143): Pfam Name: Tryp_alpha_amyl Pfam Description: Protease inhibitor/seed storage/LTP family
MASSSSSSHRRLILAAAVLLSVLAAASASAGTSCVPGWAIPHNPLPSCRWYVTSRTCGIGPRLPWPELKRRCCRELADIPAYCRCTALSILMDGAIPPGPDAQLEGRLEDLPGCPREVQRGFAATLVTEAECNLATISGVAECPWILGGGTMPSK

SEQ ID NO: 36915 - DNA, 659 bp, Zea mays
  misc_feature: Ceres CLONE 1421548-F
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaacctttgctgccctactctcagcaacagcagtttcttccattcaacccactaagttcattgaaccctgctttctatttgcaaccaccaccaactacaattcagccagcttacctgctgcctacccccaagaatttctttcctttaaaccaactggcaacatttgaactctccctgcttatttaca

SEQ ID NO: 36916 - DNA, 709 bp, Zea mays
  misc_feature: Ceres CLONE 1421550-F
  misc_feature (454)..(454): n is a, c, t, g, unknown, or other
aagctggagctccccgcggtggcggccgctctagaactagtggatcccccgggctgcaggaattcgcacgagaccattacctagaacatcctaatcgaaaaagatggctgagagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagtggcccagctccaagcctcccagcatcggcgcccgccctccctcgccgagacgccgagtgccgagcgcccgagcaccccggtccccagcngccaaacagctagcaggctgcaggtatgcgctcttttgtgatgcgtccaaggagtgagctgaatgcccagaaggctagcaggctgcaaaaactgaaggaaaagccgcattcacgacccggatgagttcctttttaaaatgatcaccgtaggactggtggtgggattccaagaccctaacctgaaaataataagtttccggaaaaggaattcttctgtgaaaaaaaaaaattgggaaaatccctttaaggggttca

SEQ ID NO: 36917 - DNA, 717 bp, Zea mays
  misc_feature: Ceres CLONE 1421552-F
  misc_feature: Encodes the peptide sequence at SEQ ID NO. 36918
  misc_feature (496)..(496): n is a, c, t, g, unknown, or other
  misc_feature (611)..(611): n is a, c, t, g, unknown, or other
ggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtctaacgggaccgcaaggaggacctgcggtggtgcaagcaggcgtgcgagtgccactacggataggacaccccgcggaaagaggtatgcgagagcgagtgccgcgagcggcaccagcaagctgacgcgggcgaagacggctacagcggcgtggacgcctacgtctccccctccgggaggggcgagtgccngcgccagtgcctgcgcccgcacgaggggcagccgtgggagacccaggagtgcatgagggcgtgccgcccgcggcggactgggcgtcgacatggagcaagagtacggtcccggcancaagaccccggcaagtgccgggagagtgcaagccccaccccgcggggactgtgggaggagcagccctcctgaggatcagaaacccccggaacgggagaagaagccc

SEQ ID NO: 36918 - protein, 34 aa, Zea mays
  misc_feature: Ceres CLONE 1421552-F
MGKGSVGASWWAFLLLAGVLLVVAATAGAEDGVV

SEQ ID NO: 36919 - DNA, 728 bp, Zea mays
  misc_feature: Ceres CLONE 1421553-F
  misc_feature: Translation starting site: 260
  misc_feature (365)..(365): n is a, c, t, g, unknown, or other
ctggagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgccccggctcggcggctccggtggaggatggcctgctcnagcatggtgactttgagacagcaccaagtggtggttttgtaaaatctgcttctgttgctgagggtgcatcgtcaatccctggttggacgatcaacggcacggttgaactcatttcagcagggccaacacaggggtggcatgatcctggattgtccacaggggggaccatgcagtaaggctagggaatgatgctagcgttgggcaggtggtggactttgagaagggttcggagtatgctatcacattcagtgctgcccggacatgtgcacaactggaggcactgaatggttccgtgctaaggtgcgtggctcaaacgtaaacttgcagagtttgacaacatagaaggctggatgcctccccttt

SEQ ID NO: 36920 - DNA, 728 bp, Zea mays
  misc_feature: Ceres CLONE 1421557-F
  misc_feature: Translation starting site: 314
  misc_feature: SWISSPROT Homolog: EC 1.11.1.7 Peroxidase
  misc_feature (537)..(537): n is a, c, t, g, unknown, or other
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaaaatgccactgtgagtctgtgaccacaccaaacgccggcggagtcgtcagtcgtgcgtgcccgtcccgttctgcccccacctcccctcccccgactccctcactcttcctcttccgttccatttcaagatccctgcagccgtccgtccatccatccatccatccatccgttaagaggagaggggaagccggccggccggccggccggtggagcggagatgagggggcagacagagacaggccggtggcgaggaggcgacggcgctgcggcgtggtgggtggccgtggtggccctgcagctgggccattcactgagccgcgcgcgggcggtgctgctggagtccaacccgggcctggcctacaacttctaccagagcagctgccccagcgcggagtccatcgtccgcagcgtcacctgggcgcaagtcgcccgcgaccccgngattccgggcccgctccctcgcctcantttcatgactgcttcgtcaagggctgcaacgcgtcgatcctgctggaacacccccaaacgggagaaaagggcggccccaaacctgtcggtgggcgggtacaaagggatttaactcctccaggcccaaggtgaaaaaagcttccccggggggggggtccctcccc

SEQ ID NO: 36921 - DNA, 680 bp, Zea mays
  misc_feature: Ceres CLONE 1421562-F
  misc_feature: Encodes the peptide sequence at SEQ ID NO. 36922
tggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccggcggcaagagcgtcgaggcccaggagcacctcgccgaagggcgcagccgcggaggccagactcgcagggagcagctggggcagcaggggtacagcgagatggggaagaagggcggtctgagcaccacggacgagtccggcggcgagcgcgccgccagggagggcgtcagcatcgacgagtcccaagttcaccaagtaagtcctatcggggtgcgctgcgtacccccccccgttccaaaaactgtctcccccaatgagaaccccctggggcgggggaaaaagggggggccccccccccccctctcttttggggggcccaacaaaaaaaaaaaaaaaaatttgggccccccccccgcgtggggggaagccaaaaccacaaaccccc

SEQ ID NO: 36922 - protein, 154 aa, Zea mays
  misc_feature: Ceres CLONE 1421562-F
  misc_feature (1)..(93): Pfam Name: LEA_5 Pfam Description: Small hydrophilic plant seed protein
MASGQESRKELDRKAREGETVVPGGTGGKSVEAQEHLAEGRSRGGQTRREQLGQQGYSEMGKKGGLSTTDESGGERAAREGVSIDESQVHQVSPIGVRCVPPPVPKTVSPNENPLGRGKKGGPPPPLSFGGPNKKKKKNLGPPPAWGEAKTTNP

SEQ ID NO: 36923 - DNA, 727 bp, Zea mays
  misc_feature: Ceres CLONE 1421566-F
  misc_feature: Encodes the peptide sequence at SEQ ID NO. 36924
aaagctggagctccccgcggtggcggccgctctagaactagtggatcccccgggctgcaggaattcgcacgagaccattacctagaacatcctaatcgaaaagttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcgtgccgttagttaaagtcgacgagatctcacagactattgattcggaaaacttcacggtcgagaactctgttctgttcgctggtccgttag

SEQ ID NO: 36924 - protein, 160 aa, Zea mays
  misc_feature: Ceres CLONE 1421566-F
  misc_feature (58)..(160): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGIVPLVKVDEISQTIDSENFTVENSVLFAGPL

SEQ ID NO: 36925 - DNA, 633 bp, Zea mays
  misc_feature: Ceres CLONE 1421568-F
  misc_feature: Encodes the peptide sequence at SEQ ID NO. 36926
  misc_feature (346)..(346): n is a, c, t, g, unknown, or other
aagctggagctccccgcggtggcggccgctctagaactagtggatcccccgggctgcaggaattcgcacgagaccattacctagaacatcctaatcgaaaagaaaaggaaagctctctcattgccaaattgcccccgactcaagccccccgcgccgccggcgttggtggaatcgatcgacccggcctcgccggacaatccaccagcgttggtttcacctcaggtttttgtgcatggaagatgacaatgaggtcactggagagtcacctgtggctgatgaatgggatatgttgtccctgacttcatcaatatatgctagcccattattccgaagaggattgatccanttaatttgcctggatatgggaatgtgattaatatcagggaggcacacaaactggattagccatttcagatggcttcgtgtcccctccagtgagcatgaaaattgccatagaaccgaccatgaggatttgccatagaaccggggctgatgaatccaatccaacaccgttaaaaaggaaaaaaattggcttgaaaaacaataataacgggggccatgtttcccccggaaaaatcccttgacctagttaggaaaaattttctttaaaaacgtggacttgcctcctcgccc

SEQ ID NO: 36926 - protein, 46 aa, Zea mays
  misc_feature: Ceres CLONE 1421568-F
  misc_feature (38)..(38): Xaa is any aa, unknown, or other
MEDDNEVTGESPVADEWDMLSLTSSIYASPLFRRGLIXLICLDMGM

SEQ ID NO: 36927 - DNA, 668 bp, Zea mays
  misc_feature: Ceres CLONE 1421572-F
  misc_feature: Encodes the peptide sequence at SEQ ID NO. 36928
  misc_feature (429)..(429): n is a, c, t, g, unknown, or other
aagctggagctccccgcggtggcggccgctctagaactagtggatcccccgggctgcaggaattcgcacgagaccattacatagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcacccgtgatcgccctcacggtggcaacccccgtgctggtgatcntcacccccggtgctggtgccggcccgcatcccccctgggggctcatgggcggcggggttccttcccctccggggggcctcggggtcccttgccctttcccgggttctccgggaagtaaaaaaaccctgaaggggaaagcccccgcgggggccccaaccgttggcccccccccaaagggagggtggggctccaaggccccccaaattcaagggatggggaaaaacccctttttaacaagg

SEQ ID NO: 36928 - protein, 116 aa, Zea mays
  misc_feature: Ceres CLONE 1421572-F
  misc_feature (78)..(78): Xaa is any aa, unknown, or other
MADHHRGATGGGGGYGDLQRGGGMHGEAQQQQKQGAMMTALKAATAATFGGSMLVLSGLILAGTRDRPHGGNPRAGDXHPRCWCRPASPLGAHGRRGSFPSGGPRGPLPFPGFSGK

SEQ ID NO: 36929 - DNA, 750 bp, Zea mays
  misc_feature: Ceres CLONE 1421581-F
  misc_feature: Encodes the peptide sequence at SEQ ID NO. 36930
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttcccccccccnnnnnnnnnnccncccccgcnnnctggcggtttnnnnnnnccaaactggactccccgcggtggcggccgctctagaactagtggatcccccgggctgcaggaattcgcacgagaccattacctagaacatcctaatcgaaaaaacactcccccgatctccgccactccaaaatgtggcgccgccaccacctcctccggctacttccacctccggccaccgccgccaccgccgcggccccttctcatttcctgcgccacctctctacctcaagcacccgcgaccccgggacgcctccctggcctcgtcactcgcgtgggggctcaccgggctcttcgagaccccggcccccggcaccaccccgggaagctttacttttccctccaatttctccgaaagtggggggctaaccaaagggcctccctcccgtgaggggggtttagggtttttccccgggaccggccaactttccccagggcccggagaaccggaaatttctttttggggcttgtcctcaagaaaaccgggggggggggtggggggatcgccccccccttccccaaaagggggggggggtacccggccacgcccaaatatgttcttgcagaccactcgtaccccccggacgcgcggccgggaattctgtccccccccgcgaggtggcgcgccgcgtctttgttgcgcagaagagtgtgtgtataaaaaaaccctctttcctctgggacccgccccccgcacgcg

SEQ ID NO: 36930 - protein, 78 aa, Zea mays
  misc_feature: Ceres CLONE 1421581-F
MWRRHHLLRLLPPPATAATAAAPSHFLRHLSTSSTRDPGTPPWPRHSRGGSPGSSRPRPPAPPREALLFPPISPKVGG

SEQ ID NO: 36931 - DNA, 524 bp, Zea mays
  misc_feature: Ceres CLONE 1421585-F
aagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttcccctcaatgctcacaagctcctatagcttccccttcttccccccattacttcccatcaatggaaagccttccggaatggggaaaaaccccgggtttttttaggccctaatagggccccccaaaaaaagaaaatttcggggaaagagaaaaaataccctttttttttcccccccgtttggggtgtttttaaaaaaaaaacgcccccccgcccctttttttttttgtgggggggggccccctttttttgtgaaaaaaaaaaaaaaaaacagtggggggggggggg

SEQ ID NO: 36932 - DNA, 667 bp, Zea mays
  misc_feature: Ceres CLONE 1421591-F
  misc_feature: Encodes the peptide sequence at SEQ ID NO. 36933
  misc_feature (667)..(667): n is a, c, t, g, unknown, or other
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctgagccgccgccgcgccgcaccgtcgn

SEQ ID NO: 36933 - protein, 108 aa, Zea mays; identical to SEQ ID NO: 16131
  misc_feature: Ceres CLONE 1421591-F

SEQ ID NO: 36934 - DNA, 673 bp, Zea mays
  misc_feature: Ceres CLONE 1421596-F
  misc_feature: Encodes the peptide sequence at SEQ ID NO. 36935
tggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaacaccgagtgccggaagagctgatgggcggcatgctccgcgggggtgcgccagttcaacgagggcccccgtggaggcgaaaccaagcgctcttactcgagggaccctcgctcggaaccctggggctttcgccttccaactttcgaacttcttcaagggctggctgcgggccgaactgggggccaaccccccttctttctgcggagggtggcctcccaaacccc

SEQ ID NO: 36935 - protein, 177 aa, Zea mays
  misc_feature: Ceres CLONE 1421596-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVKHRVPEELMGGMLRGGAPVQRGPPWRRNQALLLEGPSLGTLGLSPSNFRTSSRAGCGPNWGPTPLLSAEGGLPNP

SEQ ID NO: 36936 - DNA, 638 bp, Zea mays
  misc_feature: Ceres CLONE 1421598-F
  misc_feature: Encodes the peptide sequence at SEQ ID NO. 36937
aagctggagctccccgcggtggcggccgctctagaactagtggatcccccgggctgcaggaattcgcacgagaccattacctagaacatcctaatcgaaaaaatcaatcaaaaaaaaagttcgttttctttctcaaaccctttctagcgatgtcaggttaccctccgacgagccaaggctacagttacggctacggcggtggaaatcaacctccccctcctcagccaccttactcctccaccggaaacaatcctccgacgagccaaggtcacggttacggctacggcggcggaaacaatcctccgtacggatcatcatctccttacgctgtcccctacggcgcgtcgaagccccaatcctcgtctgctccttctgctccacgtacgctccttctcctcctcaggggacttcaaccgccaaaggacagcctttcggcggcggctacggagcttccgcgccgtctgggccctacggtgctgctcctccccgtcgggaagataccgagctgctccgccgcattcgaataccgcggttacagggctgccccccgtccttacggggaatacgagctgcttcttccccctcgggggttcctgaaacggcgggttacggtggtgctccccctcctccaagaagaa

SEQ ID NO: 36937 - protein, 163 aa, Zea mays
  misc_feature: Ceres CLONE 1421598-F
MSGYPPTSQGYSYGYGGGNQPPPPQPPYSSTGNNPPTSQGHGYGYGGGNNPPYGSSSPYAVPYGASKPQSSSAPSAPRTLLLLLRGLQPPKDSLSAAATELPRRLGPTVLLLPVGKIPSCSAAFEYRGYRAAPRPYGEYELLLPPRGFLKRRVTVVLPLLQEE

SEQ ID NO: 36938 - DNA, 642 bp, Zea mays
  misc_feature: Ceres CLONE 1421599-F
  misc_feature: Encodes the peptide sequence at SEQ ID NO. 36939
  misc_feature (483)..(483): n is a, c, t, g, unknown, or other
aagctggagctccccgcggtggcggccgctctagaactagtggatcccccgggctgcaggaattcgcacgagaccattacctagaacatcctaatcgaaaatttttttccccgctctgctctgcacgcccctctcctccctagtccctccccctacccccgcccgtcaaagcgagagcgccgtatcacctgtctctccgtccaccgccgtctcgatccgcgcccaaagatacctttcccccaccccttcctcgcgccgccgttttggtgcgaccatgacggcggagggggaggccaagaacccgtcggccggtggcggaggggataacccccagcaccagcaggctgcgccggcgccggcgccggcacagggggaagtggcgcaggacgctgcagtgcaggggacgggacaagagcaggagcgggacaaggtggatctagaggtgcaggttcgcccgcgggagaatgacgacggcgcctgcanagatctggtccttgtacaagatccagaggtcctcgccgtctaggatcccggaggaagctgcagcaaccgctgcactccaggaggaaatgaaagcgcttgtggcatcgatcccttgatgggggctggagcaaaattcacagccattgcggctttagggag

SEQ ID NO: 36939 - protein, 83 aa, Zea mays
  misc_feature: Ceres CLONE 1421599-F
  misc_feature (70)..(70): Xaa is any aa, unknown, or other
MTAEGEAKNPSAGGGGDNPQHQQAAPAPAPAQGEVAQDAAVQGTGQEQERDKVDLEVQVRPRENDDGACXDLVLVQDPEVLAV

SEQ ID NO: 36940 - DNA, 665 bp, Zea mays
  misc_feature: Ceres CLONE 1421611-F
  misc_feature: Encodes the peptide sequence at SEQ ID NO. 36941
gcggtggcggccgctctagaactagtggatcccccgggctgcaggaattcgcacgagaccattacatagaacatcctaatcgaaaactttccctgctctctccttccaactcttgtttctgcaaccccagggcgcaaccatggatcacgaccagcaagggccgggcgctcagccagatggacgcgctcgcctcccacctgcgacatccctgcctctctcacccgcgcccacgccaccttcccggtattagcagcatccaggtaggatgcgggcgcccgatgggtgagcaggtgaagggcatgctccacgacaaggggccgaatgcgtcgcacgcgctgactgtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggatggccgtcatggggttttccacgtttgggcgcgctggggctcgggggcctgtccatcgcttacgtgcctcgccaacacggcgcggcaggcgttccaccgccccccggactacgtggaggaggcgcaccgcaggatggcggaggccgcggcgcacgcgggccacaagaccgcgcaggcag

SEQ ID NO: 36941 - protein, 163 aa, Zea mays
  misc_feature: Ceres CLONE 1421611-F
  misc_feature (49)..(159): Pfam Name: Oleosin Pfam Description: Oleosin
MDALASHLRHPCLSHPRPRHLPGISSIQVGCGRPMGEQVKGMLHDKGPNASHALTVVTLFPLGGLLLVLSGLALTASVVGLAVATPVFLIFSPVLVPAALLIGMAVMGFSTFGRAGARGPVHRLRASPTRRGRRSTAPRTTWRRRTAGWRRPRRTRATRPRRQ

SEQ ID NO: 36942 - DNA, 672 bp, Zea mays
  misc_feature: Ceres CLONE 1421628-F
  misc_feature: Translation starting site: 333
caagctggagctccccgcggtggcggccgctctataactagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcgagaaatcgggacgatggtgggcctctctgaaggggagaaacacttcatccgcggcggctttgcacaagaccttcccactgatggacgtaagcggctgcatttccggtccctcttccgtcaaacccgagtcattcccaggcgaattggttcagtgccttgtcagggttgggggcccactgaaattaatcccctaaccgcccaagggctgaattatggaaaaaccaagcatttcttcccccctgaaaaaagaaaaaagtccccttttttggtcccaccgggtactccaaacccgctggaaccctcctgttttgcgggggttaaagggtttttcgaaaaaatttggccccgcgcgg

SEQ ID NO: 36943 - DNA, 665 bp, Zea mays
  misc_feature: Ceres CLONE 1421631-F
  misc_feature: Encodes the peptide sequence at SEQ ID NO. 36944
ggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcaccctttgttcctccaacaatcatcagccctattacagcagttacctttggtgcatttattggcacaaaaaatcagggcacaacaactaccaaaaccttgtgatagaaaacccttgctgcctactcccagcaacatcagtttcttccattcaaccaacttagctgcattgaaactcctgctttctattttgcaacaaccaacaaactaccatttcaggccaccctattttgcttgcctacccccccaacaattttcttttccatttcaacccaatctgaccagcacttgtaacttctccctgg

SEQ ID NO: 36944 - protein, 103 aa, Zea mays
  misc_feature: Ceres CLONE 1421631-F
MAAKIFCLLMLLGLSASAATATIFPQCSQAPIASLLPSYLSPAVSSVCENPILQPYRIQQAIAAGILPLSPFVPPTIISPITAVTFGAFIGTKNQGTTTTKTL

SEQ ID NO: 36945 - DNA, 648 bp, Zea mays
  misc_feature: Ceres CLONE 1421634-F
  misc_feature: Encodes the peptide sequence at SEQ ID NO. 36946
  misc_feature (648)..(648): n is a, c, t, g, unknown, or other
atagctggagctccccgcggtggcggccgctctagaactagtggatcccccgggctgcaggaattcgcacgagaccattacctagaacatcctaatcgaaaaacactctgcccagctaagctccctccgtccatcggcatggcgactaccactactaccatcctcctcctcctcctcgtcgcagccactgccgtctcggcggccgacctctccgtgtaccacaacgtgcacccgccatccccgtccccgctcgagtccatcatcgcgctcgcccgcgccgacgacgcgcggctcctcttcctctcatccaaggcggcctcgtccggcggcgtcacctccgctcccgtcgcctccggccagactccgccctcgtacgtcgtccgcgcggggctcggcaccccggtccagcagctgctcctcgcgctcgacaccagcgccgacgccacctggtcgcactgcgcgccgtgcgacacgtgccccgccggcagccgcttcatcccggccagctcctcctcgtaagcctccctcccgtgcggctccgactggtgcccgctcttcgagggccagccctgcccggcgaaccaggacggttcggcgcccgctgcgggcgtgcgccttctccaagccgtttcgcggacacctcggtcn

SEQ ID NO: 36946 - protein, 126 aa, Zea mays
  misc_feature: Ceres CLONE 1421634-F
MATTTTTILLLLLVAATAVSAADLSVYHNVHPPSPSPLESIIALARADDARLLFLSSKAASSGGVTSAPVASGQTPPSYVVRAGLGTPVQQLLLALDTSADATWSHCAPCDTCPAGSRFIPASSSS

SEQ ID NO: 36947 - DNA, 644 bp, Zea mays
  misc_feature: Ceres CLONE 1421636-F
  misc_feature: Encodes the peptide sequence at SEQ ID NO. 36948
aaagctggagctccccgcggtggcggccgctctagaactagtggatcccccgggctgcaggaattcgcacgagaccattacctagaacatcctaatcgaaaaactacgctccacgaacacgcacgtccgaacaattccatcctagctagctagcagttctcatcacgccaaccacctacgacgagcatggccgccagagcaagaacccacggccctctcttctccctcctcccctcctcctccaccaccacctcctcctcctcgcggtactcgccgtcggtaatagcagcagcagcagcaaacggtgccccggcgtgccttccatgaatgcgcagcaggcgtgcggcgcggtggccgggacgcggagcatgctggaggtctgcctccgcaccatccgcggcggcgcgccgctgccggggacgcggcacgcggcggtggccgtgcgcggcgcgctcgacgcggacgacggcggcagggccgccgcaacgtggctgctggacggcggctcggtgacagaggatggggagaggaccgccgttgccaggtggacggtggggtagaggaactgatctagtcggcatggtgcgcgtagcgagccgacctcgaccgcacccggttgtgacgggcatcggtgcacgggacga

SEQ ID NO: 36948 - protein, 78 aa, Zea mays
  misc_feature: Ceres CLONE 1421636-F
MNAQQACGAVAGTRSMLEVCLRTIRGGAPLPGTRHAAVAVRGALDADDGGRAAATWLLDGGSVTEDGERTAVARWTVG

SEQ ID NO: 36949 - DNA, 559 bp, Zea mays
  misc_feature: Ceres CLONE 1421641-F
  misc_feature: Translation starting site: 184
aaagctggagctccccgcggtggcggccgctctagaactagtggatcccccgggctgcaggaattcgcacgagaccattacctagaacatcctaatcgaaaaaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggcgctacgcgcagcgtgtcggcaccggcgcccccgtctacctcgccgctggtctcaaatacttcgccgctgaggttctgggacctcgcccgtaatgctgccaggggacaacaaaaaaacctccatttttcccccgccccggggcttcttgcggaatccggaaccaacaaggaacttgggaaaactttttgggcggggttgacttttcccccacggggggggggcc

SEQ ID NO: 36950 - DNA, 647 bp, Zea mays
  misc_feature: Ceres CLONE 1421642-F
  misc_feature: Encodes the peptide sequence at SEQ ID NO. 36951
  misc_feature (217)..(217): n is a, c, t, g, unknown, or other
  misc_feature (286)..(286): n is a, c, t, g, unknown, or other
aagctggagctccccgcggtggcggccgctctagaactagtggatcccccgggctgcaggaattcgcacgagaccattacctagaacatcctaatcgaaaaatacatttcgactctcaactcccaaggtcccttttttttctcgatctggaagcgccgcagtagcagccatggacgtgagcggagcaggcgggaaggcgaagaagggcgcggcgggngcgcaagggccggcgggccgacgaagaagtcggtgtcgcggtccgccagggccgggctgcagttccccngtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaataagaagacgcgcatcatcccgcgccacgtgctcctcgccatccgcaacgacgaggagctcggtaagctgctggccggcgtcaccatcgccccacggcggcgtcctcccccaacaatccacactggggcttcctcccccaaaaaaagggggcccgaaaaaagggccggccaaaggaaccccccaaaaagggcgcccccaaaaacccccccccaaaaaaggg

SEQ ID NO: 36951 - protein, 159 aa, Zea mays
  misc_feature: Ceres CLONE 1421642-F
  misc_feature (26)..(103): Pfam Name: Histone Pfam Description: Core histone H2A/H2B/H3/H4
MDVSGAGGKAKKGAAGAQGPAGRRRSRCRGPPGPGCSSPVSRVGRYLKKGRYAQRVGTGAPVYLAAVLEYLAAEVLELAGNAARDNKKTRIIPRHVLLAIRNDEELGKLLAGVTIAPRRRPPPTIHTGASSPKKRGPEKRAGQRNPPKRAPPKTPPQKR

SEQ ID NO: 36952 - DNA, 700 bp, Zea mays
  misc_feature: Ceres CLONE 1421644-F
  misc_feature: Encodes the peptide sequence at SEQ ID NO. 36953
aagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccaacaactttgcccgtggtcactacaccattggccaaggagattgttgacctatgcccttgatcgcatcaggaaagctggcccaacaactgccactgggtcctcaaggggtttcttcgtcttaaaacctttgttggggggaaggaacggggctccgggccctgggtttcccctccccccaaaaag

SEQ ID NO: 36953 - protein, 115 aa, Zea mays
  misc_feature: Ceres CLONE 1421644-F
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGQGDC

SEQ ID NO: 36954 - DNA, 723 bp, Zea mays
  misc_feature: Ceres CLONE 1421651-F
  misc_feature: Translation starting site: 398
  misc_feature (481)..(481): n is a, c, t, g, unknown, or other
ggagctccccgcggtggcggccgctctagaactagtggatcccccgggctgcaggaattcgcacgagaccattacctagaacatcctaatcgaaaactaccaccggggaactactcccgggtcggcatcgccgccgcctcccccaaaaaccctagcaggcttccccgctatcactccaaggggcccgaccgtggcggacacgaagaatacgaagaactccacggaccacatgcatacaacaagctgcagcatgatacgaagagtggcaaggacgcttctcggctacagagaccgccctcacgactctcaagaactctaagtctaagctagtgatcatcgctaacaactgcccgcaccttcctaagcctgaaattgaatactattgctacggctcacgatgtcactgtccaccactaccctggaaacgacgtcgaccctggaactgcctgaggaaaatacattcaggtctgctgccatcacncaaaaagatccgtggcgattctgatatcatcactgactactccgggtgagcattcaagaagcccctgcagtaggaggatcttactgccttggaacctctgacgagtgacacagccttagcaactcctacaactgacttaactgcaacatagacaccacctagagctctgcacccgtgatagacatataatctagcgtcagcttactacgagggacacatcatagcaaggaaccttcatcgac

SEQ ID NO: 36955 - DNA, 605 bp, Zea mays
  misc_feature: Ceres CLONE 1421661-F
  misc_feature: Encodes the peptide sequence at SEQ ID NO. 36956
aaactggagctccccgcggtggcggccgctctagaactagtggatcccccgggctgcaggaattcgcacgagaccattacctagaacatcctaatcgaaaaagcaagcaattgtcaaccgactctatcttagctctctttgcaagccagtaggtcaccactcaaaagcttgtgaagcaggtgagatgggcaaggaggtggatgtgtccactctagaggccggcggcgtccgtgaccgtgactacgcggaccctccgccggcaccgctgatcgacatcgacgagctcggcaagtggtccctgtaccgcgccgtgatcgccgagttcgtggccacgctgctgttcctgtacatcacgggtgccacggtgatcgggtacaacaccaaacgaccctcgcttcggggcaacccgctgcaacgcttggcatctgggcatccgtgggcttcggcggcttaaatttaaccccggtaaagggaacccccgggtttttggggggggcaatttaaccccggggggccaattttggccctttctggggggcaaaagggcccccgggggggggccctttctttttaaaaagggcccccaaaaaaaacccttgggtttt

SEQ ID NO: 36956 - protein, 89 aa, Zea mays
  misc_feature: Ceres CLONE 1421661-F
MGKEVDVSTLEAGGVRDRDYADPPPAPLIDIDELGKWSLYRAVIAEFVATLLFLYITGATVIGYNTKRPSLRGNPLQRLASGHPWASAA

SEQ ID NO: 36957 - DNA, 633 bp, Zea mays
  misc_feature: Ceres CLONE 1421664-F
  misc_feature: Encodes the peptide sequence at SEQ ID NO. 36958
  misc_feature (159)..(159): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
aagctggagctccccgcggtggcggccgctctagaactagtggatcccccgggctgcaggaattcgcacgagaccattacctagaacatcctaatcgaaaatgcacacattccgcgcacaccccggcagccgcaaacgccttcgccgtcgcgtcccgcntcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcaagcaaggtcccgcgacaaaggttacccttccctttaggttgggagccatatactgggtggagaccacccctcttggtcaccgggggggtttagaacttttttccccccgagaaaaaaacccccccttggggttggggggggnnnaaaaaattccccccaaaaaagaaccccccgggggggggggggcggcccccccccccaaaaaaaaaa

SEQ ID NO: 36958 - protein, 83 aa, Zea mays
  misc_feature: Ceres CLONE 1421664-F
  misc_feature: SWISSPROT Homolog: EC 5.3.3.2 Isopentenyl-diphosphate Delta-isomerase
MAAAVVDDAGMDAVQKRLMFEDECILVDEQDNVVGHESKYNCHLMEKIDSENLLHRAFSVFLFNSKYELLLQARSRDKGYPSL

SEQ ID NO: 36959 - DNA, 640 bp, Zea mays
  misc_feature: Ceres CLONE 1421666-F
  misc_feature (550)..(550): n is a, c, t, g, unknown, or other
  misc_feature (599)..(599): n is a, c, t, g, unknown, or other
  misc_feature (640)..(640): n is a, c, t, g, unknown, or other
aagctggagctccccgcggtggcggccgctctagaactagtggatcccccgggctgcaggaattcgcacgagaccattacctagaacatcctaatcgaaaaaaataatgaaaaggggttaatagtctgcgtggatcttcagccgtttcagacacaatacccagaattttcgagctgaaaaattttgttcttctgcgttcccatcgagtttatcctctactctgtgtgcccctttgaatattcatacgacgacgcgtgattttggttttgaatagatagattagaagcaaggattggctatggaggatgcaaacgcgattaggtattggtgtcacatgtgctctcgatccgtgaatccagtcatcgaaggcgacgtaatcaactgcaacttctgccaaagcggattcgtcgaagaaatggacgaaactccagaacaggccaccaatgatcaccctcatcaagcttctgagtctctctgggctcccatcttgctcgggatgatgaacgatcatgatcagcatcagagagcctctgtcgaaaacgaagatgancaacatgatgacgaacgatgatgatggtcagatttacgatggagagtcnattttggacggcacctgaagagatcatgaggaggaagaggn

SEQ ID NO: 36960 - DNA, 679 bp, Zea mays
  misc_feature: Ceres CLONE 1421668-F
  misc_feature: Translation starting site: 222
aaagctggagctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcaaccccgctgatgttgccggacccagcgagggggtggcggctatctccaagaggggcaaggtagggccgaaccggtgcaacgcctgcaggaagagggtaggacttacgtgattcaactgccggtgtgggaacttgtactgcgcactccaccgctactccgacagcccaactgcaagttcgactaccggac

SEQ ID NO: 36961 - DNA, 703 bp, Zea mays
  misc_feature: Ceres CLONE 1421670-F
  misc_feature: Encodes the peptide sequence at SEQ ID NO. 36962
aagctggagctccccgcggtggcggccgctctagaactagtggatcccccgggctgcaggaattcgcacgagaccattacctagaacatcctaatcgaaaaagttctactccccgctccccattcacgcactctcactctacctccctccctccctcgccggcgccgcgcgtgctcccgcgggatgctgcgtgcggcgcggtacctgctggggtcgccgggcgcgagcgggttcgggtccaggtcgacggcggaggaggtgaccccggacctgggcgcgacgacggccatcatcacgggcgccacgtccgggatcggcgccgagacggcgcgcgtgctggcgaagcgcggcgcgcgcgtggtgatcccggcgcggagcgccaaggcggcggaggacgtgcgcgcgcgcatcgtggccgagtgccccgccgccgccgtcctcgtgctcccgctcgacctcagctcgctcgcgtccgtgcgcgccttcgccgacaggttcctagcgctcggcctcccgctccacctcctcatgtacgtacgttcgtcgatcggggcgccgccaccgccgccctcgtccaagtccacagtacatgtatgtatgcgtatgtgtgtgatgcctgtgcgcgcgcgcgtgcagaaacaacgcggcaagttctcgcacgggcagctggcgctctcggaggacggcgtggagatgaccttcg

SEQ ID NO: 36962 - protein, 173 aa, Zea mays
  misc_feature: Ceres CLONE 1421670-F
MLRAARYLLGSPGASGFGSRSTAEEVTPDLGATTAIITGATSGIGAETARVLAKRGARVVIPARSAKAAEDVRARIVAECPAAAVLVLPLDLSSLASVRAFADRFLALGLPLHLLMYVRSSIGAPPPPPSSKSTVHVCMRMCVMPVRARVQKQRGKFSHGQLALSEDGVEMTF

SEQ ID NO: 36963 - DNA, 661 bp, Zea mays
  misc_feature: Ceres CLONE 1421679-F
  misc_feature: Encodes the peptide sequence at SEQ ID NO. 36964
  misc_feature (479)..(479): n is a, c, t, g, unknown, or other
acccgcggtggcggccgctctagaactagtggatcccccgggctgcaggaattcgcacgagaccattacctagaacatcctaatcgaaaaagaaagagtccgtaaacaactcccggccatggcgaccgcagaccgggtcgccgccaccttcctctcctctttccccactcaccatccccgccccttttcctccgtttccctcgtgacaaaccctgtcctacccgtctcccttcgggccgctgtcacaggtggcccacggctcgcctcccgtctccgggtccaccgcgtcggcgccgccgtcgcccagcttcccaccacgaatccggaggtagcttctggggagaagaagatcagatggtcatcaagggctgtgcggtcttttgcgatggcagagctggaggcccggaagatgaggtaccctaccacaggcaccgaggggctcctcatgggcattcttgttgaaggaactagtggcgcancaaaactttttgcgtgctaatggaaccacacttctcaaagtgcgtgaggaggcagcgaatgttccttgggaaatcagaaatgttttactttagttcccatgcttccaccattgaaagaagcctgcacaacgaagcccttgattggggctgtcaatgaaaaattggaaatcagggggagggag

SEQ ID NO: 36964 - protein, 37 aa, Zea mays
  misc_feature: Ceres CLONE 1421679-F
  misc_feature (32)..(32): Xaa is any aa, unknown, or other
MAELEARKMRYPTTGTEGLLMGILVEGTSGAXKLFAC

SEQ ID NO: 36965 - DNA, 660 bp, Zea mays
  misc_feature: Ceres CLONE 1421681-F
  misc_feature: Translation starting site: 191
  misc_feature (390)..(390): n is a, c, t, g, unknown, or other
  misc_feature (395)..(395): n is a, c, t, g, unknown, or other
  misc_feature (635)..(635): n is a, c, t, g, unknown, or other
  misc_feature (660)..(660): n is a, c, t, g, unknown, or other
tggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacgggtctcntttcntgttcgggggaggaggcggtggtggtgtaccagagcagcgccaaccctctgcccagcggcatcccggcctacaccgtgcagatcatcaacgtctgcggcggagggtgcaccgtgtacgacgtgcacgtctccctgcgcgacttcgcctcacggagctcgtcgaccggccaagttcagcgcgtcgcctcgacgactgcgtcgtcagggcggcgccgctgggacccagcgagacgtctcttncagtactccaactcttctctacagn

SEQ ID NO: 36966 - DNA, 664 bp, Zea mays
  misc_feature: Ceres CLONE 1421688-F
  misc_feature: Encodes the peptide sequence at SEQ ID NO. 36967
aagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccggggctgatcctggccggcaccgtgatcgcgctcacggtggccaccccccgtgctggtgatcttcagcccggtgcttggtgccggccgccatcgcgctggccctcatggcggccggtttcctcacctccggcggcctcggcgtccctgcgctgtccgtgttctcctgaatgtacaagtacctgacgggcaaacacccgcggggcgccgaacagcttgaaccaccccaaggcgaggctggcgtcccaggcccgccgacatcaaggatgcagcacagccaccgcatccaccaggcgcca

SEQ ID NO: 36967 - protein, 76 aa, Zea mays
  misc_feature: Ceres CLONE 1421688-F
MADHHRGATGGGGGYGDLQRGGGMHGEAQQQQKQGAMMTALKAATAATFGGSMLVLSGADPGRHRDRAHGGHPPCW

SEQ ID NO: 36968 - DNA, 670 bp, Zea mays
  misc_feature: Ceres CLONE 1421695-F
  misc_feature: Encodes the peptide sequence at SEQ ID NO. 36969
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaatttccacaagacccttgcgtgctctctctctctcctcttggcgacgactgggtggcaggtgcccaggtcttcttgggacccttccggcgacaagcaccaccagcttgcaggtttcaagatggaagtggtaaaaactacacatgctgggcatgcaaaatctcttgtatcaactattgattttagtacctgtcctgatggtattgtatgtgtgggtggtgatgggattgtaaatgaggtcctcaatggtcttctatgcagagatgatcaaaatatgtctgcctctgtaccaataggtataatacctgctgggtctgataactcacttatttggacagtcttgggtgtcaaggatccattttctgcagcattgtcaattgtcaggggaaggtctacacctattgatgttttctctgttgaatggattcaaagtggactatgcattatggtacaacggtatcatatttttgttttgttagcgatgttcttgaactctcaaagagtatcagaacatttttgtcccttaccatacttgaagctggtttcccaaattctgggtttgcaaaatan

SEQ ID NO: 36969 - protein, 149 aa, Zea mays
  misc_feature: Ceres CLONE 1421695-F
  misc_feature (1)..(101): Pfam Name: DAGK_cat Pfam Description: Diacylglycerol kinase catalytic domain (presumed)
  misc_feature: SWISSPROT Homolog: EC 2.7.1.91 Sphinganine kinase
MEVVKTTHAGHAKSLVSTIDFSTCPDGIVCVGGDGIVNEVLNGLLCRDDQNMSASVPIGIIPAGSDNSLIWTVLGVKDPFSAALSIVRGRSTPIDVFSVEWIQSGLCIMVQRYHIFVLLAMFLNSQRVSEHFCPLPYLKLVSQILGLQN

SEQ ID NO: 36970 - DNA, 752 bp, Zea mays
  misc_feature: Ceres CLONE 1421703-F
  misc_feature (573)..(573): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaacttttgagaactccccttctccgccactaccgaagcccttgtacccctcaccgccgccgctgctgctagggagcttccatccgcgcgcgcctacaacgagagctagcagcggtagcggccgttatcttgtcgctccggctccgttcgtgtacccaagtcccagcctagatgccgcagatgggaggggtccactgatcagatccgcccccggctggttcgttaaggagccgggttcccgagcggcccgtggggcttttgccaaagaaccgggttctttccaagtcgccctcaaaccccgaaggcccccgggaaatttcgtggccccccggggggcccccccccccccccgggcgcccggggggggttgggcctccgccccccctcccccccccagggggaaccccccaattgtttcgccggggggcctcccccccccgcccgcccccggggggggggggtttttctttctccngcccccaaanccgcccggggggggtttgaaaaatatacttagccccccattctgggggaaaaaccgacccccaaatttttttgctcgtccaagaggaacaaaacaagggcgccccggagaaattgagaaaaatagaaaaaaactttcccccccccccccccgccggggagaagaaagaa

SEQ ID NO: 36971 - DNA, 652 bp, Zea mays
  misc_feature: Ceres CLONE 1421714-F
  misc_feature: Encodes the peptide sequence at SEQ ID NO. 36972
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (582)..(582): n is a, c, t, g, unknown, or other
  misc_feature (584)..(584): n is a, c, t, g, unknown, or other
ctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgcgtgacnnnnnncggggcaaggnangaaaaagctgctggtggtggtcggcggctgggacccggagacgtgggcgccgacggacgcggtgctct

SEQ ID NO: 36972 - protein, 122 aa, Zea mays
  misc_feature: Ceres CLONE 1421714-F
  misc_feature (3)..(50): Pfam Name: F-box Pfam Description: F-box domain
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPPPGPSQSLPLFCQVAAA

SEQ ID NO: 36973 - DNA, 722 bp, Zea mays
  misc_feature: Ceres CLONE 1421724-F
  misc_feature: Encodes the peptide sequence at SEQ ID NO. 36974
gctccccgcggtggcggccgctctagaactagtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcaacttcatctggtacggcgacttctcggcgccgcagcgggcggcgatcaccgacttcgtctcgtcgctgacggcggcggccccgggccgcgcgcagccggagccgtccgtggccacgtggttcaagacggcgcgcaagtactacgcccagctccaagggtgccgttcccggcgctgcgcctcggctcccacgccgtcgaccggaactgctccctcggcaggcgcctgaccgagagggacctgctcaggctccgcgccaggggaagccccggccccgccatccaactggtgctcacggccgccggactgtgccgtggacgggttctgccagtcccggtggcgcacgcacggcgcgtc

SEQ ID NO: 36974 - protein, 129 aa, Zea mays
  misc_feature: Ceres CLONE 1421724-F
MACYNTASLAATLLAFALTFQACLAGRRLTALVQEPAITMRYHKGALLSGPIAVNFIWYGDFSAPQRAAITDFVSSLTAAAPGRAQPEPSVATWFKTARKYYAQLQGCRSRRCASAPTPSTGTAPSAGA

SEQ ID NO: 36975 - DNA, 686 bp, Zea mays
  misc_feature: Ceres CLONE 1421729-F
  misc_feature: Encodes the peptide sequence at SEQ ID NO. 36976
ctccccgcggtggcggccgctctagaactagtggatcccccgggctgcaggaattcgcacgagaccattacctagaacacctaatcgaaaaactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccattgcccgtgccaacagccgcatcccaagcccgtgccagctgcaagggaacctgcgggcgttgggcagcccccccgaatcctgggcccagtgcgtccgaagtttcttaaagcatctatttgtcgccccgatggtggaacccccctaattgcccccccccccgtggcccatcccgtttcccgcaaccagttggtttcccaatacaccttctgggtgaggttgggacccctcccacc

SEQ ID NO: 36976 - protein, 135 aa, Zea mays
  misc_feature: Ceres CLONE 1421729-F
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPLPVPTAASQARASCKGTCGRWAAPPNPGPSASEVS

SEQ ID NO: 36977 - DNA, 872 bp, Zea mays
  misc_feature: Ceres CLONE 1421738-F
  misc_feature: Encodes the peptide sequence at SEQ ID NO. 36978
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (759)..(759): n is a, c, t, g, unknown, or other
ggggnnnccccccccccccccctcccaccccgccccgnntnnnatttgtgcactttttcaaactggagctccccgcggtggcggccgctctagaactagtggatcccccgggctgcaggaattcgcacgagaccattacctagaacatcctaatcgaaaaaaaaaaaaacgtgctgtcttcccgtctcttcccaatgcggcgtctcgctctcctcttcctcctgcctctcctcctcgccaccggcgtcaccacggcgtcagcggagcccgcgacccctcccgcctctcctcctcctcctcctccaccaccagctcgcgcggattcctgcgctactactctcgaagttgtccggaggtcgagctgtatgtgcgttctggatattgaatcgatcatcctctttgtacccttatcctgccggtcttggtccgctcaacacgccccatcttttgatctatagttgcgtaggtgtagggactctccgtacaaagttagcttcatcctccacattctatttaacatatccaagcgcactaattttctttctctcccgagctcacctttctgggtgttatttccttgataattcatatcctttctttaagagtccaatctcaagtcacccttacctccacatctatactactttttttctccacccccttagctcccccccgtctgccgctataactgtatcgttacaaaccacacgtctcacgcgtaagaaaaccgaatgtaacaaacgactacagtacctaccngaatagtcaccggccaaccacccgctctcctcctcttcttccgtatagcctcacaacatataatatacatctgatcatcaaattaagaacacattgcaacgtcaactctcaca

SEQ ID NO: 36978 - protein, 87 aa, Zea mays
  misc_feature: Ceres CLONE 1421738-F
MRRLALLFLLPLLLATGVTTASAEPATPPASPPPPPPPPARADSCATTLEVVRRSSCMCVLDIESIILFVPLSCRSWSAQHAPSFDL

SEQ ID NO: 36979 - DNA, 702 bp, Zea mays
  misc_feature: Ceres CLONE 1421748-F
  misc_feature: Encodes the peptide sequence at SEQ ID NO. 36980
aagctggagctccccgcggtggcggccgctctagaactagtggatcccccgggctgcaggaattcgcacgagaccattacctagaacatcctaatcgaaaaatcgcacatattatttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactattaccattcagccagctagctactgcctactctcagcaacaacaacttcttccatttaaccaattggccgcactgaaccccgctgcttatttgcagcagcaaatactactaccatttagccagctagctgcagcaa

SEQ ID NO: 36980 - protein, 181 aa, Zea mays
  misc_feature: Ceres CLONE 1421748-F
  misc_feature (1)..(181): Pfam Name: Zein Pfam Description: Zein seed storage protein
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLLPFSQLATAYSQQQQLLPFNQLAALNPAAYLQQQILLPFSQLAAA

SEQ ID NO: 36981 - DNA, 831 bp, Zea mays
  misc_feature: Ceres CLONE 1421749-F
  misc_feature: Encodes the peptide sequence at SEQ ID NO. 36982
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ggggnnnnnccccccccccccccccccccccggcgccccccnnnngttcgccttttaaaagctgggactccccgcggtggcggccgctctagaactagtggatcccccgggctgcaggaattcgcacgagaccattacctagaacatcctaatcgaaaaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaaccgctagctggtgctggtgacggggggcacccaagccggaatacactgtgggacgtgtgggccgggaaactaccccttactaccgtcgggctaaacccgtcggccccccggggttctgtggacagaccggaatcgagtaagttcccccaagaagagggggggcccccctttctagaggagaaaacctgggccccccagggaccccctcggcaggggaaaatgccacccccaaacgggcgcaacctcgagagtttccaacaccctagaggggggaaaaaacggtgattgtgagggggccctcctcaggttttccccctcacccgcggggggtggggtgtctccgcggtcgcccttattgttcatttttgcccgcctttgcgagattgcggacatatgaagcctctcctccgctggtgtccccgcctgcgatctccttccgacactccgcctccgcgt

SEQ ID NO: 36982 - protein, 55 aa, Zea mays
  misc_feature: Ceres CLONE 1421749-F
MTLSLSTSFLPIPAAARTTARTLRSVVPSQGMRCSMRKKGLHPEIYEDAKVYCNR

SEQ ID NO: 36983 - DNA, 641 bp, Zea mays
  misc_feature: Ceres CLONE 1421767-F
  misc_feature: Encodes the peptide sequence at SEQ ID NO. 36984
ggagctccccgcggtggcggccgctctagaactagtggatcccccgggctgcaggaattcgcacgagaccattacctagaacatcctaatcgaaaaagtcttcgcattgaactctccacacctcacccaccaagagaccaatccagcagcacacgcctctccgtcgtcgtctccgataactcatcgtcgaaatcctgcccttctagcttcgcttccttcagctaactggtttcgatggcgctgctggtgcggagggcacggagggcggcgaccaaggccgcggtgtccctcgccggcagaaccggcagcgtggagcttgccatcccggcgcacttccggtgcccgatctcgctggacctcatgcgggaccccgtcacggcgccggcgggaatcacgtacgaccgcgagagcatcgaggcgtgtctggacacgggccgcgccacctgccccgtcacccacgcggcgctccgccacgaggacctcgtccccaccacgccatccgtcgcgtcatccaggactggggcgtcgcaaccgctcccgcggcgtcaagcgcatccccacgcccaaaatcccgtcacgcccgtccaggcctccgagcttctcttcgacctccgcggggccgcgcgccgccgcgacgccgt

SEQ ID NO: 36984 - protein, 135 aa, Zea mays
  misc_feature: Ceres CLONE 1421767-F
  misc_feature (29)..(100): Pfam Name: U-box Pfam Description: U-box domain
MALLVRRARRAATKAAVSLAGRTGSVELAIPAHFRCPISLDLMRDPVTAPAGITYDRESIEACLDTGRATCPVTHAALRHEDLVPTTPSVASSRTGASQPLPRRQAHPHAQNPVTPVQASELLFDLRGAARRRDA

SEQ ID NO: 36985 - DNA, 686 bp, Zea mays
  misc_feature: Ceres CLONE 1421768-F
  misc_feature: Encodes the peptide sequence at SEQ ID NO. 36986
  misc_feature (616)..(616): n is a, c, t, g, unknown, or other
tggagctccccgcggtggcggccgctctagaactagtggatcccccgggctgcaggaattcgcacgagaccattacctagaacatcctaatcgaaaaatacccgcccgctcgcctccctggtacgcttcgtgccgccgccgcaacctcctcctccccgtcacagattgcagatcatttaacataaatggctgactcagaggacattcagcccctagtctgtgacaatggaactggaatggtcaaggctggctttgctggagatgatgctccccgtgctgttttcccaagtatagttggtcgtccacgccacactggtgtcatggttgggatgggacagaaggatgcttatgttggtgatgaggcccaatccaagaggggtatcctgactttgaagtatcccatcgagcatgtaatcgtaagcaactgggatgacatggaaaagatctggcatcacaccttctataatgagcttcgtgtagcaccagaagagcacccagttcttcttacagaggctccctcttaccctaaggctaacagggaaaagatgacacagatcatgtttgaaactctcagtcgtcctgctatgtatgttgctattcaagctgtccattccanttatgctagtggccgtacccactgagattgccctgtagtccggagacggagtcagcacactgtcccattg

SEQ ID NO: 36986 - protein, 151 aa, Zea mays
  misc_feature: Ceres CLONE 1421768-F
  misc_feature (4)..(151): Pfam Name: Actin Pfam Description: Actin
  misc_feature: SWISSPROT Homolog: EC 2.7.10.2 Non-specific protein-tyrosine kinase
  misc_feature (144)..(144): Xaa is any aa, unknown, or other
MADSEDIQPLVCDNGTGMVKAGFAGDDAPRAVFPSIVGRPRHTGVMVGMGQKDAYVGDEAQSKRGILTLKYPIEHVIVSNWDDMEKIWHHTFYNELRVAPEEHPVLLTEAPSYPKANREKMTQIMFETLSRPAMYVAIQAVHSXYASGRTH

SEQ ID NO: 36987 - DNA, 894 bp, Zea mays
  misc_feature: Ceres CLONE 1421769-F
  misc_feature: Encodes the peptide sequence at SEQ ID NO. 36988
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (629)..(629): n is a, c, t, g, unknown, or other
nnnnnnccccccccccccccccccccnnnnnnnnnngngggggaggttttttttccaaagctgggactccccgcggtggcggccgctctagaactagtggatcccccgggctgcaggaattcgcacgagaccattacctagaacatcctaatcgaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatggcttcccttcttcccccatactttcaatcaatgatagcttcagtatgtgaaaaacccagctcttccagccctatgggctcccaccaaggtattcgcaggaaagaaaaaattaccttttaaccccctttgtggggttcaaaaaattccgcccggcgccctattcttttgggggacgcctcctttgggttaaaaagccctttgtggggcctccacactcctctctctaaaacctttgggggtatacctggtgagaacacacccgagaaaattgctctctggggcgaaacctctgttttttctccctgatcgntccgtgagaaaaaattaaaaaatttttttctcccctttttcaaaacaaatcggtgtccgatacctgtaaaaacaccccgggtgggagttatatgttggggaggacatgctgctttattcgactttggtttccccacaataaaagccaccgtggggtaaaattgatgggcgaaaagaaaagaacctctctttattttaataaacaatgtggggcggccccaaaagacccccggggcttttttatttattgggagaaaaaaatactt

SEQ ID NO: 36988 - protein, 71 aa, Zea mays
  misc_feature: Ceres CLONE 1421769-F
MATKIFSLLMLLALSACVANATIFPQCSQAPMASLLPPYFQSMIASVCEKPSSSSPMGSHQGIRRKEKITF

SEQ ID NO: 36989 - DNA, 671 bp, Zea mays
  misc_feature: Ceres CLONE 1421776-F
aagctggagctccccgcggtggcggccgctctagaactagtggatcccccgggctgcaggaattcgcacgagaccattacctagaacatcctaatcgaaaagtgcctcgttcattactgccagtcgatcgttgtgtgacatcttatcgacctccgaccagtacaagactacgtacgtgaaacctactgacaatgcgaggacaactggtgtgtggcagtgctatccatcttggaggccctgggacggctgtccttgctggacaaaagcccacttctggcaactgtaagaagcttgctgctcttcctgacgacaacccatgctgctgctgctgctgcttctggaagctctctgtcttttcccactgagatcgtccgggcatcacccatgaactactcttctaggagaccatgtacgtcatcacaccgatgccatgcctatgttgatgcctctaggatggaggcgtactgcctctcatggaagtagatagcggcacactagagctgttcggaccgatgccgagacgacctcccgacgtcatcatgcgcttgataaacgtctgcaccaggtaggagcagcgtgtagcacgcttttggtatctggcggggtagttctcatgcatgggagctggtcagccctgccaagtttccatcgagccggacttcacagggtgg

SEQ ID NO: 36990 - DNA, 735 bp, Zea mays
  misc_feature: Ceres CLONE 1421777-F
aagctggagctccccgcggtggcggccgctctagaactagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcaagaaatcgggacgatggtgggcctctctgaaggggaagaaacacttcatccccggcggcattgcccaggaccttcgccttgatggacctaggccgttgcatttccgggcccctctcccgcccaaaccggaattctttccccagggaaatggttctcaccgcgggttaggttggggggccccccaaaaaaaatccccttgggccaaggggtgaattaaaaaaaaccaaaaattttttcccccctgaaaaaagaaaaaagatccccctttttttggcgagggtgggccccacccccggaagccctcttttttgggggggaagagccccaaaaaaaaatttcggtggaaaacccccttttttctccccaaaaaaaaatttttttggggggggaaaaaaaggggcgcggggtgctcttttt

SEQ ID NO: 36991 - DNA, 647 bp, Zea mays
  misc_feature: Ceres CLONE 1421781-F
  misc_feature: Encodes the peptide sequence at SEQ ID NO. 36992
  misc_feature (359)..(359): n is a, c, t, g, unknown, or other
  misc_feature (393)..(393): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcaaacgggaccgcaaggaggacctgcggtggtgcaagcaggcgtgcgagtggcantacggaaaggacacccccgcgaaagaggaatgcnaaagcgagtgccgccagcggcaccagcaagctgacccggccgaggacggcaacagcggcggtggacccctacctctcccgcttccgggaggggcgaggtgccggccccagtggcttgcccccccacgaagggccaaccggtgggaaaccccagaagtggcttgagggggggccccccccccccggaaatgggcctttcaaattggaaacaaaaaataccggcccccggaacccaaaacccggggaaaatgcccg

SEQ ID NO: 36992 - protein, 117 aa, Zea mays
  misc_feature: Ceres CLONE 1421781-F
  misc_feature (52)..(52): Xaa is any aa, unknown, or other
  misc_feature (64)..(64): Xaa is any aa, unknown, or other
MGKGSVGASWWAFLLLAGVLLVVAATAGAEDGVVKRDRKEDLRWCKQACEWXYGKDTPAKEECXSECRQRHQQADPAEDGNSGGGPLPLPLPGGARCRPQWLAPPRRANRWETPEVA

SEQ ID NO: 36993 - DNA, 666 bp, Zea mays
  misc_feature: Ceres CLONE 1421783-F
  misc_feature: Encodes the peptide sequence at SEQ ID NO. 36994
  misc_feature (666)..(666): n is a, c, t, g, unknown, or other
ggagctccccgcggtggcggccgctctagaactagtggatcccccgggctgcaggaattcgcacgagaccattacctagaacatcctaatcgaaaaaaaggtatggaggaggcaccaacgagggagccgaagaggctgcgccaggacgccgcggttacttccgccgcggcggcggctgaggagcctcagtacgtgtacctgcctatcgccgacgccatgaaggttcccggcgtccgggtttgcctcttcgccgttgtctccgagatcggcatcaccgaccgcagccgtggcacggatttcactcttaggttgaggattgtggatcaatcatgcatggatggaatctctgtaacagtttttgctgacaaaactactctattgccttgtgtcaagtcaagtggagatgtgatcagtctccataacgtcatgataacgatgcatggggagttctttgtttcattttacaaagaagtttcttcatttgcgctatttgaaagcaaagtagctgagtgcagcccatatcagacttctgtgaaatatcatggcagcaaccatgacaaagaactttttaaccaagatggagaacgtgccttgcatataatccctctgggtctgaaagattttgaatttgcagttaaagaggttaaaaatctgaattctcctttn

SEQ ID NO: 36994 - protein, 187 aa, Zea mays
  misc_feature: Ceres CLONE 1421783-F
  misc_feature (62)..(164): Pfam Name: Telo_bind Pfam Description: Telomere-binding protein alpha subunit, central domain
MEEAPTREPKRLRQDAAVTSAAAAAEEPQYVYLPIADAMKVPGVRVCLFAVVSEIGITDRSRGTDFTLRLRIVDQSCMDGISVTVFADKTTLLPCVKSSGDVISLHNVMITMHGEFFVSFYKEVSSFALFESKVAECSPYQTSVKYHGSNHDKELFNQDGERALHIIPLGLKDFEFAVKEVKNLNSP

SEQ ID NO: 36995 - DNA, 680 bp, Zea mays
  misc_feature: Ceres CLONE 1421792-F
  misc_feature: Encodes the peptide sequence at SEQ ID NO. 36996
  misc_feature (398)..(398): n is a, c, t, g, unknown, or other
aagctggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacgggtcgtcttcntgttcgggggaagaagcggtgttggtgtaccagagcaaccgcaacccctctgccagcggcatcccggcctacaccgtgcagatcatcaacgtctgcggcggaggggtgccccgtgtacaacgtgcacgtctccctggggggacttccccctaaccggagctcctccaccccggcaaatttccaccgggtcgcccttcaacgactgcgtccttcaaggggcggcccccccctttgaaaccccacgaggaccgtcctcccttccagtacttccaacttctttcc

SEQ ID NO: 36996 - protein, 118 aa, Zea mays
  misc_feature: Ceres CLONE 1421792-F
MGEWCFKKRAALVIIVAIISSLQLLLITAQEAGGDHEVWSSSSSPAGGRGGGAVVVPTARMGPDGSSSCSGEEAVLVYQSNRNPSASGIPAYTVQIINVCGGGVPRVQRARLPGGTSP

SEQ ID NO: 36997 - DNA, 867 bp, Zea mays
  misc_feature: Ceres CLONE 1421809-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (380)..(380): n is a, c, t, g, unknown, or other
  misc_feature (568)..(568): n is a, c, t, g, unknown, or other
  misc_feature (637)..(637): n is a, c, t, g, unknown, or other
  misc_feature (696)..(696): n is a, c, t, g, unknown, or other
  misc_feature (697)..(697): n is a, c, t, g, unknown, or other
nnnnnnnnnnnnnaaaannnnnaaaaaggggggnttttttttnnaaaaactggagctccccgcggtggcggccgctctagaactagtggatcccccgggctgcaggaattcgcacgagaccattacctagaacatcctaatcgaaaaattgatccctgaaagccatccacaattggtagctcgttgatccaaatccaagagctcacgtcaacgcactgtctcgcctgttaattagtcgacgacgtcttcttctatgtccaggctgatggctgccatgctgttctggagggtgcgcgtcgccggcggcgctagctcaccggtaacggctacgctgctggcctgtggggtgttcccatgccgggatgcttccttccttctcncccgcgggccgcgacctgaacccccctctgcttgtgggcttgggccaggatcggcccagggtttcggaaatccctccgggaacaaccccaaaagaaaaccaggggaacaagtacccaggaacccttcccttatgaagtcgaaagggacgcccaaccgggggaccccccaaggaaccaccgcctctagnagggatgggccccgggggggtgccgaataaagcaagggccgcccccgaccaaggggccccgccccacgntgccccgaaccaagggcggttcggggcttgttccctagttccggttccatgggaacccnnatctaaaagggccatttgccgcgagaaacggccacggaataaagctcttatcctcggggctaacccaggcgacagcggaaagaacacagcgacccctacggccccgacacccatggagacccggctgctcgaggccccccgcaccaccttactaccaccagagccatatt

SEQ ID NO: 36998 - DNA, 750 bp, Zea mays
  misc_feature: Ceres CLONE 1421813-F
  misc_feature: Encodes the peptide sequence at SEQ ID NO. 36999
aagctggagctccccgcggtggcggccgctctagaactagtggatcccccgggctgcaggaattcgcacgagaccattacctagaacatcctaatcgaaaaaccgcctccggcttcagttccccgaggctagaattcggatccctcccaccacatccatccccttcccttcccttccctcgtgccccgccggctctccagcgcgccgtctctgcccagatccaggagatatgcctcgctatgatgatcgctatggaggcacgcgcttgtatgttggcagattggccccccgtactcgttctcgtgatttagaatatctcttcggcaaatatggaagaatacgagaagtggagttgaagcgcgactatgcatttattgagttcagtgaacatcgtgatgccgatgaagctcggtaccaactagatggcagggatgtcgatggaagtcgcattgttgttgaagttgctaaaggggtcccacgtggtccaggtggctcccgtgaatttatggggaagaggccctccccaaggcacagttcgttgtttcaactgtggaatggaatggcccctggccaaaaaaatgtaagggttgggaatggaaaaaataaaggctacccgttggggaaaaaagaggccttataaaaaaaaaattcccaaaacacccctaaagacgctcgggggggaaaaaaaattccccccccccctccccccccccccccggggaaaagaggcccccccccccgcttttaggg

SEQ ID NO: 36999 - protein, 136 aa, Zea mays
  misc_feature: Ceres CLONE 1421813-F
  misc_feature (13)..(76): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MPRYDDRYGGTRLYVGRLAPRTRSRDLEYLFGKYGRIREVELKRDYAFIEFSEHRDADEARYQLDGRDVDGSRIVVEVAKGVPRGPGGSREFMGKRPSPRHSSLFQLWNGMAPGQKNVRVGNGKNKGYPLGKKEAL

SEQ ID NO: 37000 - DNA, 616 bp, Zea mays
  misc_feature: Ceres CLONE 1421815-F
  misc_feature: Encodes the peptide sequence at SEQ ID NO. 37001
  misc_feature (375)..(375): n is a, c, t, g, unknown, or other
aagctggagctccccgcggtggcggccgctctagaactagtggatcccccgggctgcaggaattcgcacgagaccattacctagaacatcctaatcgaaaaaaaactgcattacaccacgatacactccactacaccctctcgagcaacaccaggaaccataccaaatcccaagtagagaagagcaagggctgcagctggcaagaagctttgctcagaaatggagttcctgtcgcagatgtggtcgctcctgggcctgctcaccatcctgcagaacgtccctcccccacgcagctgcctctcccttggtgcactcgctgtggcagtcgttccaagatctctacgccctatctaactcacgtgccgagttcctggntctgcggcgtcaagccaaggcgtttaaccgccaatccagtttaacttcagggttccttttcttttttggttccccggaaagcttaagttttggtggcgggtcctccccggggtccgggggcaaccccccggggggggccccccccccccgggggggggcctttccccaaaaacctggggggggggaaacttttaaggggccccccccggggggggggacccccccccgaaaaacttttttg

SEQ ID NO: 37001 - protein, 44 aa, Zea mays
  misc_feature: Ceres CLONE 1421815-F
MEFLSQMWSLLGLLTILQNVPPPRSCLSLGALAVAVVPRSLRPI

SEQ ID NO: 37002 - DNA, 706 bp, Zea mays
  misc_feature: Ceres CLONE 1421819-F
  misc_feature: Encodes the peptide sequence at SEQ ID NO. 37003
  misc_feature (431)..(431): n is a, c, t, g, unknown, or other
  misc_feature (433)..(433): n is a, c, t, g, unknown, or other
  misc_feature (434)..(434): n is a, c, t, g, unknown, or other
  misc_feature (446)..(446): n is a, c, t, g, unknown, or other
aagctggagctccccgcggtggcggccgctctagaactagtggatcccccgggctgcaggaattcgcacgagaccattacctagaacatcctaatcgaaaaagttctactccccgctccccattcacgcactctcactctacctccctccctccctcgccggcgccgcgcgtgctcccgcgggatgctgcgtgcggcgcggtacctgctggggtcgccgggcgcgagcgggttcgggtccaggtcgacggcggaggaggtgaccccggacctgggcgcgacgacggccatcatcacgggcgccacgtccgggatcggcgccgagacggcgcgcgtgctggcgaagcgcggcgcgcgcgtggtgatcccggcgcggagcgccaagggcgcggaggacgtgcgcgcgcgcatcgtggccgagtgccccgccgncnngcgtctcgtgcntccgctcgacctcagctcgctcgcgtccgtgcgcgccttcgccgacaggttcctagcgctcgggctcccgctcccactcctcatgtacgtacgttcgtcgatcggggcgcccgccaccgccggccctcgtccaagtccaccagtacatgtatgtaatgccttatgtggtggatgcccgtgccccccccccttgcaaaaaccaacccgggcaagtccccccacgggcacttggccctttcggaagaaacgggttggaaaaa

SEQ ID NO: 37003 - protein, 174 aa, Zea mays
  misc_feature: Ceres CLONE 1421819-F
  misc_feature (83)..(83): Xaa is any aa, unknown, or other
  misc_feature (84)..(84): Xaa is any aa, unknown, or other
  misc_feature (88)..(88): Xaa is any aa, unknown, or other
MLRAARYLLGSPGASGFGSRSTAEEVTPDLGATTAIITGATSGIGAETARVLAKRGARVVIPARSAKGAEDVRARIVAECPAXXRLVXPLDLSSLASVRAFADRFLALGLPLPLLMYVRSSIGAPATAGPRPSPPVHVCNALCGGCPCPPPLQKPTRASPPTGTWPFRKKRVGK

SEQ ID NO: 37004 - DNA, 575 bp, Zea mays
  misc_feature: Ceres CLONE 1421825-F
aagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacagggggcacacttagctaaagctaaaaccttcgcccccggggcaaaaaaaagtggggggcccttcccccccttttttctcttaggccccgggccggggggttttcctctgcccccccggggcccgcgcccccggggggggggggggtttttgtgtaaacccccggcccccagagacacacggggaggggggtttctctccccccccccccaaggggggggccccccccccggggggggggggggggggctttctttcccccc

SEQ ID NO: 37005 - DNA, 649 bp, Zea mays
  misc_feature: Ceres CLONE 1421826-F
  misc_feature (291)..(291): n is a, c, t, g, unknown, or other
  misc_feature (292)..(292): n is a, c, t, g, unknown, or other
  misc_feature (305)..(305): n is a, c, t, g, unknown, or other
aaagctggagctccccgcggtggcggccgctctagaactagtggatcccccgggctgcaggaattcgcacgagaccattacctagaacatcctaatcgaaaaagaagccaaattggtgctcctcttatctcgccgcgccgccaccgctccatttccgctcccccagcccccccaaaagaacctcgtaaccctactcgcgggattccgcaggccgccgcttgcttagggttcatcactcctgttcacacccgatggccgtggacgaggcgagcagcagtggcggtgggaggnnaaggggtgcgagntcttgtaccccttagaactccaacgtgtaaaaaaacgcctcgacgaagataaggcgtgagcactactccgacacaaagtgcaataaactggctcaccccatctaacgatatacgcccgaggagagcaggatgcacttctagctgctggtgtagtaaatcgacagcctcgagctcgagcaccttcccgcttcctgcgcacgcggctgactgctctgtcccataaatgcggagatcgtggaaataacggcatggacagaagaaggcaccatgggaacacgagcgtcggtcaagtacgcttagcaggtagcacacgaatgactaagctcaccagaaggatgaggagt

SEQ ID NO: 37006 - DNA, 975 bp, Zea mays
  misc_feature: Ceres CLONE 1421829-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (469)..(469): n is a, c, t, g, unknown, or other
  misc_feature (474)..(474): n is a, c, t, g, unknown, or other
  misc_feature (476)..(476): n is a, c, t, g, unknown, or other
  misc_feature (478)..(478): n is a, c, t, g, unknown, or other
  misc_feature (479)..(479): n is a, c, t, g, unknown, or other
  misc_feature (486)..(486): n is a, c, t, g, unknown, or other
  misc_feature (487)..(487): n is a, c, t, g, unknown, or other
  misc_feature (494)..(494): n is a, c, t, g, unknown, or other
  misc_feature (501)..(501): n is a, c, t, g, unknown, or other
  misc_feature (505)..(505): n is a, c, t, g, unknown, or other
  misc_feature (508)..(508): n is a, c, t, g, unknown, or other
  misc_feature (509)..(509): n is a, c, t, g, unknown, or other
  misc_feature (525)..(525): n is a, c, t, g, unknown, or other
  misc_feature (540)..(540): n is a, c, t, g, unknown, or other
  misc_feature (541)..(541): n is a, c, t, g, unknown, or other
  misc_feature (559)..(559): n is a, c, t, g, unknown, or other
  misc_feature (560)..(560): n is a, c, t, g, unknown, or other
  misc_feature (710)..(710): n is a, c, t, g, unknown, or other
  misc_feature (744)..(744): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaagactggggggactccaccgncgggngngnncggccgnnctctagnaactagntggnatnncccccgggctgcaggnatattcgcacgaagnnaccattacctagaacatnncctaatcgaaaaacgatcacacaccacttccacagcagtagcaagaggggatagagcagggcacacacacacacacaccactaggctagcctagccttttagtcgtcgaagaagggagcagaaggggcgcgcacgcaaagcaggcaagcnagaaagaagagcccgatcgacccgaaaagctagnccgccaatggggcaaggtcctcccaaaaattatgggggggccgggaaacctctggctggggccttgggccctgggcccgtgttcaattccccccaggggggggggaaaattttgggacccccccccccacccgggaaaaaaagggggccccccccgggggggtgggaccccccaaaaaatttttccccccccctttttaaaccccccccggggggggggggggggcccccc

SEQ ID NO: 37007 - DNA, 571 bp, Zea mays
  misc_feature: Ceres CLONE 1421830-F
  misc_feature: Translation starting site: 319
  misc_feature (353)..(353): n is a, c, t, g, unknown, or other
aagctggagctccccgcggtggcggccgctctagaactagtggatcccccgggctgcaggaattcgcacgagaccattacctagaacatcctaatcgaaaaaccacgatttttctcactactagtcgcaactcgcaagcaaatcgaacgaacccagccgaagcgcgagccgcgagctgagcaaggcggaggcggcggaaccggcgatggagcggctgcagcggatctttggcgcctccggcatggggcagccgccgacggactccgcgctgctcgactcttccgagcagtctacatctcctccctcgggcttcttcagatgctccagcccgggagggccggcctgcccatggnagtcatgggtctcatgctccgggaagtccttggagaactaccccgtcagggtttctcaacattttcccccttgccaaaaaagggactggggtcaaagttaagggccctaacccttttttcaaaaaaaatggtttttaattgttttaaaaaaccgggggggcaaaaaggggtgtggggggggggttaaccccaaccccggggtttcgggggggggggta

SEQ ID NO: 37008 - DNA, 684 bp, Zea mays
  misc_feature: Ceres CLONE 1421832-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (169)..(169): n is a, c, t, g, unknown, or other
  misc_feature (448)..(448): n is a, c, t, g, unknown, or other
  misc_feature (449)..(449): n is a, c, t, g, unknown, or other
  misc_feature (455)..(455): n is a, c, t, g, unknown, or other
  misc_feature (477)..(477): n is a, c, t, g, unknown, or other
  misc_feature (480)..(480): n is a, c, t, g, unknown, or other
  misc_feature (533)..(533): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactggggactccaccgncggtggcggccgctcctagaactagtggaacccccgggctgcaggaattcgcacgaaaccattacccagaacatcctaatcgaaaacacgatcacacaccactccacagcagtagcaagagggatagagcaaggccacacacacacacacaccactaggctagcctagccttttagtcgtcgaaggaggagcaagaaaggcgcgcacgcaagcaggcaagcaagaagagagccgatcgaccgagagctagcacgcgatggcgaagtcttccaagatganntgtgcngcagctctgctgggcttggccntgnccgtgtcaatcgccgaggcgaggaaacatcagaccacgacgaccgaaaaaaangacaaccccgtgggtgcacccccaaaacttcccggcccttcgaacgccttgggggggggccgttcccgggggtttcgggggccctcccccggggggagaattcctgggaaccaaaatttccccggttataacaaatgccccggaaacggac

SEQ ID NO: 37009 - DNA, 579 bp, Zea mays
  misc_feature: Ceres CLONE 1421834-F
  misc_feature: Encodes the peptide sequence at SEQ ID NO. 37010
  misc_feature (421)..(421): n is a, c, t, g, unknown, or other
  misc_feature (422)..(422): n is a, c, t, g, unknown, or other
  misc_feature (510)..(510): n is a, c, t, g, unknown, or other
  misc_feature (533)..(533): n is a, c, t, g, unknown, or other
aagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgaactccctccgccgggccacccggacccgtccgtcctgnnagcgctgctccggctgctgggcgtccgcggcgttttctccgagtcccacgagtccacgccccacacgcggcggcggctattcgcgctncacgcggtggggcgcaccctggntgcggggccccgctcgggcgcgtcctacgccgactacgtgctgcac

SEQ ID NO: 37010 - protein, 132 aa, Zea mays
  misc_feature: Ceres CLONE 1421834-F
  misc_feature (80)..(80): Xaa is any aa, unknown, or other
  misc_feature (117)..(117): Xaa is any aa, unknown, or other
MPPPSANGATAAAAAARDDMSPAEARLAMMELANMVSVPMALAAVIRLGVPAAVWAGGANAPMSAAELPPPGHPDPSVLXALLRLLGVRGVFSESHESTPHTRRRLFALHAVGRTLXAGPRSGASYADYVLH

SEQ ID NO: 37011 - DNA, 598 bp, Zea mays
  misc_feature: Ceres CLONE 1421837-F
  misc_feature: Encodes the peptide sequence at SEQ ID NO. 37012
  misc_feature (486)..(486): n is a, c, t, g, unknown, or other
  misc_feature (551)..(551): n is a, c, t, g, unknown, or other
aagctggagctccccgcggtggcggccgctctagaactagtggatcccccgggctgcaggaattcgcacgagaccattacctagaacatcctaatcgaaaactcttttccgccgcccatggtggccgcgccaccaccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttcttttctcatgcatcagcagagaaagctcttcagaattttactggtcatgtgatgccaaacactgaccggccatttaaattngactgggcatcgtatagcatgggtgaaaagcgatctgaagtggcttctgatcactcgatatttgntggcgatctagctgctgatgtcactgatgaaatgctgctggagcttt

SEQ ID NO: 37012 - protein, 160 aa, Zea mays
  misc_feature: Ceres CLONE 1421837-F
  misc_feature (50)..(121): Pfam Name: RRM_1 Pfam Description: RNA recognition motif. (a.k.a. RRM, RBD, or RNP domain)
  misc_feature (123)..(123): Xaa is any aa, unknown, or other
  misc_feature (145)..(145): Xaa is any aa, unknown, or other
MVAAPPPPPQFAKHFAAGPPPPPQAGAGRRTPTPPSSGSGGNGCEENKTIWVGDLQYWMDENYLHNCFGPSGEVVTIKVIRNRQTGQSEGYGFVEFFSHASAEKALQNFTGHVMPNTDRPFKXDWASYSMGEKRSEVASDHSIFXGDLAADVTDEMLLEL

SEQ ID NO: 37013 - DNA, 660 bp, Zea mays
  misc_feature: Ceres CLONE 1421845-F
  misc_feature: Encodes the peptide sequence at SEQ ID NO. 37014
ggagctccccgcggtggcggccgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaa

SEQ ID NO: 37014 - protein, 156 aa, Zea mays
  misc_feature: Ceres CLONE 1421845-F
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEK

SEQ ID NO: 37015 - DNA, 689 bp, Zea mays
  misc_feature: Ceres CLONE 1421851-F
  misc_feature: Encodes the peptide sequence at SEQ ID NO. 37016
  misc_feature (448)..(448): n is a, c, t, g, unknown, or other
aagctggagctccccgcggtggcggccgctctagaactagtggatcccccgggctgcaggaattcgcacgagaccattacctagaacatcctaatcggaaaactagactacacccccatcccgcagcagccaaaacctacctagccgccgccgcaggcggccccccatcgccgccaagatgcagatctttgtgaagactctgacggggaagaccatcactttggaggtggagtcctcggacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaangatcagcacaggcacaagaaagtgaagctctccgtgctgcagttctataaggtggacgacgccacagggcaggtgacccgcctccgccagggatggcccaacccgaatggggggcggggcgtctttatggccacccctttcaacggcattatgggggaaaggggggcctcccctttgtcaaacccaaaggggtatttccttccccaatttgtttttcccccccccttaaaggttttgaatg

SEQ ID NO: 37016 - protein, 170 aa, Zea mays
  misc_feature: Ceres CLONE 1421851-F
  misc_feature (6)..(74): Pfam Name: ubiquitin Pfam Description: Ubiquitin family
  misc_feature (101)..(141): Pfam Name: Ribosomal_S27 Pfam Description: Ribosomal protein S27a
  misc_feature (90)..(90): Xaa is any aa, unknown, or other
MQIFVKTLTGKTITLEVESSDTIDNVKAKIQDKEGIPPDQQRLIFAGKQLEDGRTLADYNIQKESTLHLVLRLRGGAKKRKKKTYTKPKXDQHRHKKVKLSVLQFYKVDDATGQVTRLRQGWPNPNGGRGVFMATPFNGIMGERGASPLSNPKGYFLPQFVFPPPLKVLN

SEQ ID NO: 37017 - DNA, 831 bp, Zea mays
  misc_feature: Ceres CLONE 1421852-F
  misc_feature: Encodes the peptide sequence at SEQ ID NO. 37018
  misc_feature (20)..(20): n is a, c, t, g, unknown, or other
  misc_feature (21)..(21): n is a, c, t, g, unknown, or other
  misc_feature (38)..(38): n is a, c, t, g, unknown, or other
  misc_feature (57)..(57): n is a, c, t, g, unknown, or other
  misc_feature (59)..(59): n is a, c, t, g, unknown, or other
  misc_feature (497)..(497): n is a, c, t, g, unknown, or other
ggggggggtgggcgcccccnnccggccttccaccccanaaaaagcgcatatcccccntntggagctgcccgcggtggcggccgctctagactagtggatcccccgggctgcaggaattcgcacgagaccatagctagaacatcctaatcggaactccaaagtttcgtccaccatttcgctcccgccagcaccgatttgtttactggtctctcccacccgaggaggcggagctccctacgacgactgaacgatgtgcggcggggcgatccttgccaaccttggagagacggcgcaccgccagctcacctaccgggacatcccagagcacaaaaagatactcaagaaggggccccggtggcgggaaggcactcagttcgcgggggaaagaccaattaggacctcggagggccaaccctggagggtattgggaggggccgaattgcaggggggtgccccccccccccttcctgggagggggattttaagaagtgggtttntgcaacaaccacggcgggtggtgtcccccagagggaggttttctccaccccaagcgccctaaagagcccatgaactaaggggggtcaccccacgcccggggcgggtgggggttgtgataataacctcctttcccggcacctacccggcccgcggcgccctctgggggggagagggggcgtgggccagcatgaaggcgtagcgccctacgtgggggggtcgccgctttgcgccccgggaactcttccgcaccccgccccgccgaagatcgccgcgagatctcccccaacgcgccggcagggcgggcggcattttgtcgggtacataccccccccg

SEQ ID NO: 37018 - protein, 102 aa, Zea mays
  misc_feature: Ceres CLONE 1421852-F
  misc_feature (83)..(83): Xaa is any aa, unknown, or other
MCGGAILANLGETAHRQLTYRDIPEHKKILKKGPRWREGTQFAGERPIRTSEGQPWRVLGGAELQGGAPPPLPGRGILRSGFXQQPRRVVSPRGRFSPPQAP

SEQ ID NO: 37019 - DNA, 662 bp, Zea mays
  misc_feature: Ceres CLONE 1421855-F
aaagctggagctccccgcggtggcggccgctctagaactagtggatcccccgggctgcaggaattcgcacgagaccattacctagaacatcctaatcgaaaaattggggcaggatcccgcgatggctcccagctcggtggcgtggaacccgtccgtggcgcccgcgaggccgaggtcgagctcggtgagcgccgcggctgctgccgggtgcgctgcgagcgccggcccgatgtcctccgtccagcagtagaactcggagaggtcgagcgccctgagcgctgggcagtccccgaggagcggctcgagatccgcgccggcgtcgaggcccggcgggcgctggtgccagcgcacgagcttgacgctgcggaggcgggacctccagtgcggggtgaggctgacgagcgtggtggggtcgcggcagtagacggcgagcgaggacacggcggggaagcagtaggcgaggcgcgccgcgaccagctcgttctgctccgcgacctgctgcggcgtcacggacggcgcgacagcgtcggccgacggcgccgcggaggagaggaacgggtggccccactgggacgccagcgagaggtcgagccgctccagcgccgggaagcagaactccggcctgatgaagaggaacgcgggcgaccgtgtgtccccgcgca

SEQ ID NO: 37020 - DNA, 724 bp, Zea mays
  misc_feature: Ceres CLONE 1421859-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (295)..(295): n is a, c, t, g, unknown, or other
  misc_feature (297)..(297): n is a, c, t, g, unknown, or other
  misc_feature (299)..(299): n is a, c, t, g, unknown, or other
  misc_feature (300)..(300): n is a, c, t, g, unknown, or other
  misc_feature (310)..(310): n is a, c, t, g, unknown, or other
  misc_feature (312)..(312): n is a, c, t, g, unknown, or other
  misc_feature (315)..(315): n is a, c, t, g, unknown, or other
  misc_feature (319)..(319): n is a, c, t, g, unknown, or other
  misc_feature (337)..(337): n is a, c, t, g, unknown, or other
  misc_feature (378)..(378): n is a, c, t, g, unknown, or other
  misc_feature (593)..(593): n is a, c, t, g, unknown, or other
  misc_feature (598)..(598): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaagctggggactccaccgncngnntggcggccgncntcntagnaaaactagtggatccccncgggctgcaggaattcgcacgagaccattacctagaacatncctaatcgaaaactcgattcgcatccccttttcccgtccatgacgcgcgccggcgggcggtgccagtgccaccgcgctcgcggcggccatgaaacattaagcagccgctgcacggccgcatcgacgctggtccgggcctgctctcctctcttcgctggctcctccctcgggcctggttcctccgggccttccggcctggccggccttttccccgnaaaanccggggccttttcccttccaacctggtggggggggccttccgacctttcggcgcccagggccctccttttggcccccccgggggaaacccttggtcccaaaaaaaaggggggggccccccggggcc

SEQ ID NO: 37021 - DNA, 681 bp, Zea mays
  misc_feature: Ceres CLONE 1421863-F
  misc_feature: Translation starting site: 257
  misc_feature: SWISSPROT Homolog: EC 3.4.25.1 Proteasome endopeptidase complex
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (507)..(507): n is a, c, t, g, unknown, or other
  misc_feature (508)..(508): n is a, c, t, g, unknown, or other
  misc_feature (518)..(518): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (530)..(530): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagctggggctccacgcggtggcggccgctctagaactagtggatcccccgggctgcaggaattcgcacgagaccattacctagaacatcctaatcgaaaaaaatctagcaaacggaaatcccatctcgccgccgccgcgatgtctcgccgctatgacagtcgcacgacgatcttctcgccggaggggcgtctctaccaggtggagtacgcgatggaggcgatcggcaacgccgggtcagccctcgggatcctggcggccgacggcgtagtcctggtcggcgagaagaaagtgaccctcaagctccctcagaaactccgctcccgcgaagagaatgtacagatcgactccccacctggcgtgcgctgtggcaggaatcatgtccgacgccnnacatctcatnaannnacgccgncctcacgcccagggttacgcgctcttctacccagagcccatccccgtcgaggaactcgtccagtccctctgcgacaaacaagcagggttacacccaggtttggtggcctcccgccccccttggggggccccttcccaattcccccgggtgg

SEQ ID NO: 37022 - DNA, 671 bp, Zea mays
  misc_feature: Ceres CLONE 1421876-F
  misc_feature: Encodes the peptide sequence at SEQ ID NO. 37023
aaagctggagctccccgcggtggcggccgctctagaactagtggatcccccgggctgcaggaattcgcacgagaccattacctagaacatcataatcgaaaaatatatcgattcgctgccacacagatagggttttctctccacgcagcgcgctcctcgatccccaacaggcaacagccaagccgccgtcgtcccccgctccgtagtacggcgccgccagatcgtcagccaccatgatcatctccaagaagaaccgccgcgagatctgcaaatacctgttccatgagggggtcttgtacgccaagaaggactacaacctggccaagcaccctaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctcaacctgccatcagaggttgtgcctaataccctcaagaagtcttccaagcccccgtctcgtcccttcggctctggcccacctggtgaccgccccaggggccctcctcgttatgaaggtgacaggcctaggtttggtgatagggatggttacagaggaggtccgcgtggcgctccaggtgactttggtggtgataagggt

SEQ ID NO: 37023 - protein, 146 aa, Zea mays
  misc_feature: Ceres CLONE 1421876-F
  misc_feature (3)..(98): Pfam Name: S10_plectin Pfam Description: Plectin/S10 domain
MIISKKNRREICKYLFHEGVLYAKKDYNLAKHPKLDVPNLEVIKLMQSFKSKEYVRETFSWQYYYWYLTNDGIEHLRSFLNLPSEVVPNTLKKSSKPPSRPFGSGPPGDRPRGPPRYEGDRPRFGDRDGYRGGPRGAPGDFGGDKG

SEQ ID NO: 37024 - DNA, 665 bp, Zea mays
  misc_feature: Ceres CLONE 1421878-F
  misc_feature: Translation starting site: 423
aaagctggagctccccgcggtggcggccgctctagaactagtggatcccccgggctgcaggaattcgcacgagaccattacctagaacatcctaatcgaaaaagccagccaaatcttccacctcctccatttccagccccgtccccacaccagctcgcgtaacctcctgcccatggctggaggcggcggcgcaggcgcgggctcgtcgtccggcggcggcggagggggcggcagggagggcgactgggactgcggcagctgcggcaaccgcaactacgccttccgctcgctctgcaaccgctgcaagcagccgcgcctcctcgtcgaccccaacaccccgcgcgactccaagtggctaccccgcgccggggactggatctgcaccgcagcaactacttgcaaatgcaaactggccctatgggatggctggtagatatgggatgcaatcttctggttggccatttggcaacggcaacccaaatcagtttttaggtgttccaaaggattggcgtaatggagattggctctgcagctgtggatttcataactattcatctcgtactcagtgcaaagagtgtggtgcacctgtaccatcgggcattccctccacaacaatgaaagctacatctgatgcctcttccacattaggaactaagcggttggct

SEQ ID NO: 37025 - DNA, 506 bp, Zea mays
  misc_feature: Ceres CLONE 1421885-F
  misc_feature (1)..(1): n is a, c, t, g, unknown, or other
  misc_feature (279)..(279): n is a, c, t, g, unknown, or other
  misc_feature (307)..(307): n is a, c, t, g, unknown, or other
  misc_feature (308)..(308): n is a, c, t, g, unknown, or other
  misc_feature (321)..(321): n is a, c, t, g, unknown, or other
  misc_feature (343)..(343): n is a, c, t, g, unknown, or other
  misc_feature (344)..(344): n is a, c, t, g, unknown, or other
naaagctggagctccccgcggtggcggccgctctagaactagtggatcccccgggctgcaggaattcgcacgagaccattacctagaacatcctaatcgaaaaaagtccggagcaagagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggggctcngccgcgccctctccgtcgtctcattccnngcactgtccttcntcggctcgtccattcggttccnncagaaactgctgctgctgctgcgggtgccgcggcgggaaggccaggcttccaaaccttaccggaaccccccccaaagggtgccccccggtggccggggccgcggtggacttacccgggggcaaaaaaaaaaaaggtggcggtcccccccggaactccccggg

SEQ ID NO: 37026 - DNA, 667 bp, Zea mays
  misc_feature: Ceres CLONE 1421897-F
  misc_feature: Encodes the peptide sequence at SEQ ID NO. 37027
aaagctggagctccccgcggtggcggccgctctagaactagtggatcccccgggctgcaggaattcgcacgagaccattacctagaacatcataatcgaaaaatatatcgattcgctgccacacagatagggttttctctccacgcagcgcgctcctcgatccccaacaggcaacagccaagccgccgtcgtcccccgctccgtagtacggcgccgccagatcgtcagccaccatgatcatctccaagaagaaccgccgcgagatctgcaaatacctgttccatgagggggtcttgtacgccaagaaggactacaacctggccaagcaccctaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctcaacctgccatcagaggttgtgcctaataccctcaagaagtcttccaagcccccgtctcgtcccttcggctctggcccacctggtgaccgccccaggggccctcctcgttatgaaggtgacaggcctaggtttggtgatagggatggttacagaggaggtccgcgtggcgctccaggtgactttggtggtgataa

SEQ ID NO: 37027 - protein, 144 aa, Zea mays
  misc_feature: Ceres CLONE 1421897-F
  misc_feature (3)..(98): Pfam Name: S10_plectin Pfam Description: Plectin/S10 domain
MIISKKNRREICKYLFHEGVLYAKKDYNLAKHPKLDVPNLEVIKLMQSFKSKEYVRETFSWQYYYWYLTNDGIEHLRSFLNLPSEVVPNTLKKSSKPPSRPFGSGPPGDRPRGPPRYEGDRPRFGDRDGYRGGPRGAPGDFGGD

SEQ ID NO: 37028 - DNA, 623 bp, Zea mays
  misc_feature: Ceres CLONE 1421899-F
  misc_feature (303)..(303): n is a, c, t, g, unknown, or other
  misc_feature (316)..(316): n is a, c, t, g, unknown, or other
  misc_feature (319)..(319): n is a, c, t, g, unknown, or other
  misc_feature (349)..(349): n is a, c, t, g, unknown, or other
  misc_feature (364)..(364): n is a, c, t, g, unknown, or other
  misc_feature (372)..(372): n is a, c, t, g, unknown, or other
  misc_feature (373)..(373): n is a, c, t, g, unknown, or other
  misc_feature (432)..(432): n is a, c, t, g, unknown, or other
aaaagctggagctccccgcggtggcggccgctctagaactagtggatcccccgggctgcaggaattcgcacgagaccattacctagaacatcctaatcgaaaaaacgaagaaccgaatgcccagtcctgaatcacgtcttcacccgtgctcgtgcgctgcgcccatcccttccgcctccacgctccccacgtgcaccgtgcacagcaccacacagccaggtccccatggcggcggcggcggcggttgcctctgcgacgacggcggaagacgaagcgcgcctgctgcgccctggagagcaggcngagcacggccgcngcngcgccctgggaataacctctgctcagccgncgggtccgggcccgncgccccgnnttaggtctcggggttcggctcgcccctcttaaaaaagcctccgggcgcttcggacttgnctcaagaaaaatgggacgctctacccagcaggtgggccccggcggccatgaaatgccccccgtcccaaattggcaaaagactttatttggaatccttttcaaaacaatttcctgggaaaccaccgggttgcgccgggtaaaaacccccctttgtttaaaaccaaaaggggaaagggcctaaaacttaaaaa

SEQ ID NO: 37029 - DNA, 576 bp, Zea mays
  misc_feature: Ceres CLONE 1421900-F
  misc_feature: Encodes the peptide sequence at SEQ ID NO. 37030
  misc_feature (199)..(199): n is a, c, t, g, unknown, or other
  misc_feature (228)..(228): n is a, c, t, g, unknown, or other
  misc_feature (265)..(265): n is a, c, t, g, unknown, or other
  misc_feature (268)..(268): n is a, c, t, g, unknown, or other
aaaagctggagctcaccgcggtggcggccgctctagaactagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagccaacgagacngcagcaatgggcgaacgtgaccgcagcgnaatctacggcggcgcccacgccaactacgggcagcancancaacagggaagaagccgcgccccaatggtgaacaagtaaaagcaatctccccaaaaaggggccacgggttccaagggcttaaagggggaaactttttccccctggggggttcttcttgggtttttttgggtttgccttaaaacccccctgggggggtgggggggggcccacccgggttttttaattttataaccccggtttgttccccccccgcttgttattttaaaaaggaggttttggggtttcctcccttacggcgccccctgtgttttttgggggagtcctcttccccaactggctttgccaaa

SEQ ID NO: 37030 - protein, 33 aa, Zea mays
  misc_feature: Ceres CLONE 1421900-F
  misc_feature (8)..(8): Xaa is any aa, unknown, or other
  misc_feature (20)..(20): Xaa is any aa, unknown, or other
  misc_feature (21)..(21): Xaa is any aa, unknown, or other
MGERDRSXIYGGAHANYGQXXQQGRSRAPMVNK

SEQ ID NO: 37031 - DNA, 712 bp, Zea mays
  misc_feature: Ceres CLONE 1421927-F
  misc_feature: Encodes the peptide sequence at SEQ ID NO. 37032
  misc_feature (1)..(1): n is a, c, t, g, unknown, or other
  misc_feature (386)..(386): n is a, c, t, g, unknown, or other
  misc_feature (427)..(427): n is a, c, t, g, unknown, or other
naaagctggagctccccgcggtggcggccgctctagaactagtggatcccccgggctgcaggaattcgcacgagaccattacctagaacatcctaatcgaaaagtccctagaaaaggccgcgtcccacgttgccttggttcccccaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgaccccggccttcgagttcanccgagagtcacgccagtggatcgaccgcatggttgactacnatgtactcgggaggcagtgtaaccgtgggctctctgttgtcgaaagctaacagctgctcaagggccctgatgcctctgggcaaagaggaaactttccttgcttgcacctccgctgggggattgaaagggttcacgggttttctttcttggcctggaaaaaacaggggagaaacttcacaacctttcggggcaacctttttggttaagggggcccccgggtgggttaatggcggaaaagaggggatatcctttcaaacctttttcggaggattcttggggccattt

SEQ ID NO: 37032 - protein, 60 aa, Zea mays
  misc_feature: Ceres CLONE 1421927-F
  misc_feature: SWISSPROT Homolog: EC 2.5.1.67 Chrysanthemyl diphosphate synthase
  misc_feature (31)..(31): Xaa is any aa, unknown, or other
  misc_feature (45)..(45): Xaa is any aa, unknown, or other
MAPAGTPGRPSRGSTRRSRRSCSPTPAFEFXRESRQWIDRMVDYXVLGRQCNRGLSVVES

SEQ ID NO: 37033 - DNA, 686 bp, Zea mays
  misc_feature: Ceres CLONE 1421931-F
  misc_feature: Encodes the peptide sequence at SEQ ID NO. 37034
  misc_feature (419)..(419): n is a, c, t, g, unknown, or other
  misc_feature (425)..(425): n is a, c, t, g, unknown, or other
  misc_feature (441)..(441): n is a, c, t, g, unknown, or other
  misc_feature (444)..(444): n is a, c, t, g, unknown, or other
  misc_feature (447)..(447): n is a, c, t, g, unknown, or other
  misc_feature (452)..(452): n is a, c, t, g, unknown, or other
  misc_feature (485)..(485): n is a, c, t, g, unknown, or other
aaagctggagctccccgcggtggcggccgctctagaactagtggatcccccgggctgcaggaattcgcacgagaccattacctagaacatcctaatcgaaaaccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccantccccncggcgccgtggaggcngcngcngtggntacggtgggtgccgtggaggccgcggctacggncggtggcggccgccctgatgggcgttggctgcttacgcggtggcggcgggtacggtggcggcgggcgctaacgggggtggtggggggccggttccggcggggggcaccggggggggggggttacgggaattcccaaggggaaattggaagaacttagccggggggggcccccccggcccaaatttacccgtttccctcccc

SEQ ID NO: 37034 - protein, 112 aa, Zea mays
  misc_feature: Ceres CLONE 1421931-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (85)..(85): Xaa is any aa, unknown, or other
  misc_feature (93)..(93): Xaa is any aa, unknown, or other
  misc_feature (94)..(94): Xaa is any aa, unknown, or other
  misc_feature (95)..(95): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAXSPRRRGGXXXGYGGCRGGRGYGRWRPP

SEQ ID NO: 37035 - DNA, 733 bp, Zea mays
  misc_feature: Ceres CLONE 1421945-F
  misc_feature: Encodes the peptide sequence at SEQ ID NO. 37036
  misc_feature (532)..(532): n is a, c, t, g, unknown, or other
  misc_feature (573)..(573): n is a, c, t, g, unknown, or other
  misc_feature (674)..(674): n is a, c, t, g, unknown, or other
cgagctggagctcaccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgctcgtctcttcggcgtggagtacatcctgaggaggaagagcttcaactctcttccgttcgaggaccgccggtgagacacacgcaccancgctacgccgcggcgggcttcgcgccgcgtgcgccgatggncgcggccgcggcgcactgtttatcgcggtctggtactcggctgtttcgcgtgttgtggctggtgcgtcgtgttgtgcggggggtagtgtgcggggtggggntgggcccatgcgcgggggggcgcgcgatgccggccgcccgcgccgccgccccccccccc

SEQ ID NO: 37036 - protein, 120 aa, Zea mays
  misc_feature: Ceres CLONE 1421945-F
  misc_feature (26)..(119): Pfam Name: DUF1264 Pfam Description: Protein of unknown function (DUF1264)
MASSDGKPLPTPASVGGGGGSSTAPPGQPTTVASKVLDMGAAAMQSLRPVKQAKQHMCTFALYAHDPKRQVETHHYVSRLNQDFLQCAVYDSDKADARLFGVEYILRRKSFNSLPFEDRR

SEQ ID NO: 37037 - DNA, 697 bp, Zea mays
  misc_feature: Ceres CLONE 1421946-F
  misc_feature: Encodes the peptide sequence at SEQ ID NO. 37038
tagagctggagctccccgcggtggcggccgctctagaactagtggatcccccgggctgcaggaattcgcacgagaccattacctagaacatcctaatcgaaaaatccatcatcgctcgctcttctcttggtcttgcaactccagtgctgctcactgccactgccagcagatcgagctgctccgcctcactagccctcttgctttgctgctgcacctgcaagtctgcaaccgcgcacagagagatgtcgacggtgagccgtgcgtccctcgaccagaagctcgccctcgccaagcgctgctcccgagaggcgaccctcgccggagccaaggcggcagcggtggcgactatcgcctccgcgatccccaccctggccagcgtgcggatgctgccatgggccaaggccaacatcaaccccaccggccaggcgctcatcgtctccacggtggctgggatggcatacttcatcgccgccgacaagaagatcctgtcgctggcgaggcgccactcgttcgagcaagcccctgagcacctcaagaacacctccttccagggcaccggccgtccccacctggctttcttcaggccgtgagacgtggcctccgtcgagctagctacctacctctttcagttcgatcgtcagtgcaaagcaccaccaatgcctgaataaatttaaatttatctacgaggctagctgct

SEQ ID NO: 37038 - protein, 115 aa, Zea mays
  misc_feature: Ceres CLONE 1421946-F
  misc_feature (11)..(89): Pfam Name: ENOD93 Pfam Description: Early nodulin 93 ENOD93 protein
MSTVSRASLDQKLALAKRCSREATLAGAKAAAVATIASAIPTLASVRMLPWAKANINPTGQALIVSTVAGMAYFIAADKKILSLARRHSFEQAPEHLKNTSFQGTGRPHLAFFRP

SEQ ID NO: 37039 - DNA, 718 bp, Zea mays
  misc_feature: Ceres CLONE 1421953-F
  misc_feature: Translation starting site: 183
aaagctggagctccccgcggtggcggccgctctagaactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgctgggcgccgaagaacagctgctgcagctgcgcgcgcgccgccgcgaggaacgccgcgccaacgcccgcgccgccgagatcttcgcgggccaccgcgccgcctggatggtagccgagcgccccttgaagcccgcgccgccgcgccccggaacaagccgccttccctcggggggaactttgcaaagccaaggccaaaccccttggccttgccccccccgcccaagggaactcgggccaggggcccccaaaggggaataaattttttaccgggctcccccgggggcccctggggggccggggaaacccggggggggggcccccccccccctgtt

SEQ ID NO: 37040 - DNA, 733 bp, Zea mays
  misc_feature: Ceres CLONE 1421956-F
  misc_feature: Encodes the peptide sequence at SEQ ID NO. 37041
aaagctggagctccccgcggtggcggccgctctagaactagtggatcccccgggctgcaggaattcgcacgagaccattacctagaacatcctaatcgaaaaacaccaccgtagcacacacgagtacaccacacactcgcctttccgatcccatccctctccagccaccttcctccgctcgccgtgcttctgcttcctccgccaccaccgacggcatggctgcgcgctgcccctacttcgccgtcgaggagtcctcccgcggcatccgctcgggggagtccccggccgcggcgctccgcctgatcctcgcgacacctggtgcgcacacacgagccctgctgctacgacacgctcggcgcgcgcactcatcgagacgccggggtttcacgatcgcgttcataaactgtttctgtgttatctgcctcgcgacttggcttgcatgatgttggcctcatttcctatggagaaatggtagatcaagggcgtctcatcaatgaagctgcttcaatcctcagagattgatgacggagacaatggctacggaaactctatcaatatcaagagaaccataaaacgatatatcaatgctggttatgctggaattatgcttgatgatcacgtggcacctaaagcatgtgaacatactgagagaacgaaagtcacatcagtggaagaagctgtcatgcacataaaagctgctgtagatgctacgaaagagagtgactctgacatt

SEQ ID NO: 37041 - protein, 80 aa, Zea mays
  misc_feature: Ceres CLONE 1421956-F
  misc_feature: SWISSPROT Homolog: EC 4.1.3.30 Methylisocitrate lyase
MKLLQSSEIDDGDNGYGNSINIKRTIKRYINAGYAGIMLDDHVAPKACEHTERTKVTSVEEAVMHIKAAVDATKESDSDI

SEQ ID NO: 37042 - DNA, 698 bp, Zea mays
  misc_feature: Ceres CLONE 1421958-F
  misc_feature: Encodes the peptide sequence at SEQ ID NO. 37043
aaagctggagctccccgcggtggcggccgctctagaactagtggatcccccgggctgcaggaattctcacgagaccattacctaaaacatcctactcgaaaaattccccatctcgccctgcccgccgaagagcgcgcaggcgccaccgtcccgggagcgcggagatcagtccactccatccacgcggggtcaggcgagcggggcgcacggacgctgcgaccgatggatctcatggatagcctctccgaatttaagcaacaggacgagagatgccactcctcactggcgagcatagctgcttccacctcaaagccaaagcatggggaccaaccagcgcatgctcctaacgtcccagcaagaccatcacaacctattaagttttcacatgatacagaaaggctgcagcacatcaattcgattacgaaatctcctgttggagcacagatcactcttgtcatatgacttctttacaagacaagacaagcttttactgcatagcagataaatgacgcaacatatgttgctattcacggcaataaagctgtctttgacagcttgataaatcaccccaaataagctatgatgggaggcgtttcctctaacagtcaagcatgacctgaagggaaagatcaccgctttttttgtaaagaattcccaaaaggctgctgttgggaactaggaagccttttcaatgttgg

SEQ ID NO: 37043 - protein, 79 aa, Zea mays
  misc_feature: Ceres CLONE 1421958-F
MDLMDSLSEFKQQDERCHSSLASIAASTSKPKHGDQPAHAPNVPARPSQPIKFSHDTERLQHINSITKSPVGAQITLVI

SEQ ID NO: 37044 - DNA, 631 bp, Zea mays
  misc_feature: Ceres CLONE 1421964-F
  misc_feature (204)..(204): n is a, c, t, g, unknown, or other
  misc_feature (207)..(207): n is a, c, t, g, unknown, or other
  misc_feature (213)..(213): n is a, c, t, g, unknown, or other
  misc_feature (251)..(251): n is a, c, t, g, unknown, or other
  misc_feature (254)..(254): n is a, c, t, g, unknown, or other
  misc_feature (306)..(306): n is a, c, t, g, unknown, or other
ctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaanggnagatcngaagcgacgataaagtcgttgctcctgtctttctgtcngcngtcgtgtgcctgcttgagctggcgggcacccgcaaggcggcaactctaccangaacaaaaattaaccttggccattgccccgccaagtaattgacagcggggcccggcttgaacctaaacttgaacccaatccgggttcggggtttaatccaaaacgagaaactgttcggcaaaaagaacagcgaataaaatgggggccggaaatccctggggaggggaccaacctttttctgttgtccccggggggacccccccaaaaaaataactttccttttcttgggaacaaaaggggggaggcctttcattcttgtaaacaaaaatattttccccccccaaaggaccggcccggagaaaacaatctcccccccggtgtggac

SEQ ID NO: 37045 - DNA, 707 bp, Zea mays
  misc_feature: Ceres CLONE 1421966-F
  misc_feature: Encodes the peptide sequence at SEQ ID NO. 37046
gctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactgggaagacaatcgcccttgagggggagtcctcagacaccattggacatgccacggcacagaccccggacaaggaggggatccccccctggaccgcaacgtcccatcctttgccggcaagccgtttgatgatggggaggacccttggcgacctcaacctcccgagggagagccccccccccttgtggccgcggccttacggggggccccccgatcttttgggaaagcccttcctgggaagacccctccctctgg

SEQ ID NO: 37046 - protein, 169 aa, Zea mays
  misc_feature: Ceres CLONE 1421966-F
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTIALEGESSDTIGHATAQTPDKEGIPPWTATSHPLPASRLMMGRTLGDLNLPRESPPPLWPRPYGGPPDLLGKPFLGRPLPL

SEQ ID NO: 37047 - DNA, 621 bp, Zea mays
  misc_feature: Ceres CLONE 1421968-F
  misc_feature: Encodes the peptide sequence at SEQ ID NO. 37048
  misc_feature (187)..(187): n is a, c, t, g, unknown, or other
  misc_feature (188)..(188): n is a, c, t, g, unknown, or other
  misc_feature (197)..(197): n is a, c, t, g, unknown, or other
  misc_feature (199)..(199): n is a, c, t, g, unknown, or other
  misc_feature (200)..(200): n is a, c, t, g, unknown, or other
  misc_feature (256)..(256): n is a, c, t, g, unknown, or other
ctggagctccccgcggtggcggccgctctagaactagtggatcccccgggctgcaggaattcgcacgagaccattacctagaacatcctaatcgaaaaactcggcacgcaggcagaggcagcacagcagcagccagctccatccatcctctttcccctcctcgcttcgcttcctcggcggattcctnnctcctcggncnngtcccgtccctttttcggcgcgcgagctcgcccgagatgggcaacgcgagatcggntgtcgctgtgaatgacgagtgcatgctcaagttcggcgagctgcattcgaagaagctgcaccgctttcttacttttcagatgggccaacaagttccagggaatcctttggggacccagtcggggaaaccgcttacccgtttcaaggaatttcaaaaaagcctcccccaaaaatgactgccaaaaccccaacttttaaatttccacttttccccccccaaaaaaattccaaaaaagagggattttttatttcctgggggccccccctcccccccagggggaaaaaaaaaaatttttttttcgccccccaccaaaaatataaagaagggggcccttgggggttttttggggaaaccccccccctctt

SEQ ID NO: 37048 - protein, 64 aa, Zea mays
  misc_feature: Ceres CLONE 1421968-F
  misc_feature (7)..(7): Xaa is any aa, unknown, or other
MGNARSXVAVNDECMLKFGELHSKKLHRFLTFQMGQQVPGNPLGTQSGKPLTRFKEFQKSLPQK

SEQ ID NO: 37049 - DNA, 827 bp, Zea mays
  misc_feature: Ceres CLONE 1421976-F
  misc_feature: Encodes the peptide sequence at SEQ ID NO. 37050
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (585)..(585): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctgggactccaccgtcggtgggcggccgctctagaactagtggatcccccgggctgcaggaattcgcacgagaccattatctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcgggcgcgatgcagtcgttgcgccccgtgaagcaggcgaagcagcacatgtgcacgtttcgcgctgtacgcgcacgaacccgaagcggcaggtggaaaanccaccactacgttctcccgcctcaaacaggaaattccttccagggggcccgtcatttgactccaaaaaagccgaaagggggtttcatgggggctggaatacaaccgggccggggaaaaactttcacccccttccccgggaaagagacacgggcctggggcccctccccaccccccccgaaaataaaattcggggccggtggaaaaacccccccccctgtgggggggtcttttggaaaaaaag

SEQ ID NO: 37050 - protein, 154 aa, Zea mays
  misc_feature: Ceres CLONE 1421976-F
  misc_feature (74)..(74): Xaa is any aa, unknown, or other
MASSDGKPLPTPASVGGGGGSSTAPPGQPTTVASKVLDMGAGAMQSLRPVKQAKQHMCTFRAVRARTRSGRWKXHHYVLPPQTGNSFQGARHLTPKKPKGGFMGAGIQPGRGKTFTPFPGKETRAWGPSPPPPKIKFGAGGKTPPPVGGSFGKK

SEQ ID NO: 37051 - DNA, 586 bp, Zea mays
  misc_feature: Ceres CLONE 1421989-F
  misc_feature: Encodes the peptide sequence at SEQ ID NO. 37052
  misc_feature (315)..(315): n is a, c, t, g, unknown, or other
  misc_feature (344)..(344): n is a, c, t, g, unknown, or other
  misc_feature (360)..(360): n is a, c, t, g, unknown, or other
  misc_feature (386)..(386): n is a, c, t, g, unknown, or other
  misc_feature (482)..(482): n is a, c, t, g, unknown, or other
  misc_feature (488)..(488): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaactggcattgcttgccacccctgcaactgcaactgcaacacagagaaagatagcgctatccagaggatcagctccggtcatccagtgaagctcaggctactctacctcgctctcggccatggcgtcaggggaagcagcagagccactgcagtacacggtgagcgagagcttcttctgcacgcacgcgctacatttccctgtcatatcccctggncgtctactctctgcagaccacgcgctgcnggtgtccatccactgncgaggctgcaagaagaagtcaagaangtgctcacagcatcgaagctgtgttgccttcaagcgtgtacaaagtgaccgttgacccgcccaacacaaggtgacggtcacccgcaccgtgggagnccgaancgcttcntcgggggcctggacaaaggccggaaagaagcggggcttttggcccaaatcggccggccccgtttagggcaagattgaacccccagaaagtc

SEQ ID NO: 37052 - protein, 73 aa, Zea mays
  misc_feature: Ceres CLONE 1421989-F
  misc_feature (42)..(42): Xaa is any aa, unknown, or other
  misc_feature (47)..(47): Xaa is any aa, unknown, or other
  misc_feature (56)..(56): Xaa is any aa, unknown, or other
MASGEAAEPLQYTVSESFFCTHALHFPVISPGRLLSADHALXVSIHXRGCKKKSRXCSQHRSCVAFKRVQSDR

SEQ ID NO: 37053 - DNA, 697 bp, Zea mays
  misc_feature: Ceres CLONE 1422004-F
  misc_feature: Encodes the peptide sequence at SEQ ID NO. 37054
aagctggagctccccgcggtggcggccgctctagaactagtggatcccccgggctgcaggaattcgcacgagaccattacctagaacatcctaatcgaaatcccgactcaggatttatacccacccccgtcggtcgatcccctccctccctcccgccgccgccgccgccgcccgtagccaagaccaagatcccgtctcggccggcgtcgcacctgacctaaccctgagccctgtgatatgccggttcaggtcggaggcaacaaggtggcggacccgaggccggccagggatggtggacctatcgcccgtaggcgacaggtcccgcgcctcctccaagaagaaccgccgccgccacaagaaggccgacgccgcctcttccgtctcgcccatgcgaaggctcttcgacaccagctcggaggtcttcgccaactcctacccgggcttcgtcccgccgccggacgccgtcgcccgcctctcgggcctcctcaatgagcttaaccctcgtgacttctgggttgccccaagcatgtccgtcttcaagcctgcccatccaacaaacccccctccagttacctatttgcacttctatggttcctccgacatatcgattggtatcttctgtttaccaaaatcatgcattattcgcctccacaacatcctgggatgacagcgtgtagcaagatactgtatggatcaa

SEQ ID NO: 37054 - protein, 125 aa, Zea mays
  misc_feature: Ceres CLONE 1422004-F
  misc_feature: SWISSPROT Homolog: EC 1.13.11.19 Cysteamine dioxygenase
MVDLSPVGDRSRASSKKNRRRHKKADAASSVSPMRRLFDTSSEVFANSYPGFVPPPDAVARLSGLLNELNPRDFWVAPSMSVFKPAHPTNPPPVTYLHFYGSSDISIGIFCLPKSCIIRLHNILG

SEQ ID NO: 37055 - DNA, 659 bp, Zea mays
  misc_feature: Ceres CLONE 1422007-F
  misc_feature: Encodes the peptide sequence at SEQ ID NO. 37056
  misc_feature (659)..(659): n is a, c, t, g, unknown, or other
ctggagctccccgcggtggcggccgctctagaactagtggatcccccgggctgcaggaattcgcacgagaccattacctagaacatcctaatcgaaaaatctcgcgactacagtgtacagccgcaaatcgggagaaggggtttttatgtctcctcgcccgctccgaatcagctcgaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggccgtgggcgtggccgtggtcgtgggcgcggtcggggtcggggacgttgagcatgctagctgcttttggaaattgcattgcgtgcatctgcagtgtaatctacattcctatcaattgtacgaagtatgcctn

SEQ ID NO: 37056 - protein, 114 aa, Zea mays
  misc_feature: Ceres CLONE 1422007-F
  misc_feature (5)..(70): Pfam Name: LSM Pfam Description: LSM domain
MKLVRFLMKLNNETVTIELKNGTVVHGTITGVDISMNTHLKTVKLTLKGKNPVTLDHLSVRGNNIRYYILPDSLNLETLLVEETPRVKPKKPTSGKPLGRGRGRGRGRGRGRGR

SEQ ID NO: 37057 - DNA, 697 bp, Zea mays
  misc_feature: Ceres CLONE 1422008-F
  misc_feature: Pfam Name: Rep_fac-A_C Pfam Description: Replication factor-A C terminal domain
aaagctggagctccccgcggtggcggccgctctagaactagtggatcccccgggctgcaggaattcgcacgagaccattacctagaacatcctaatcgaaaaggttctgtttgtttggtgagatgtgttttcctctttctcctacgttgtgagtttccatttggtggacatccttttccagatcccttcgtggattagatccacgctcctctagtcgagatcgtcttgcatttttctgagatggagattgggaccgaaaaggttgcaaaacaatgacctccaactaatacaacccacaacagctgaagaagaaatccagctttctcaaccaccaaatttggaagacaagaccgttgaagagctgctcaacatagatccggatatgtttcccgaagaaggatgtactgttactatatcaagcatcgtgcaaaatagcagatggtggtacccatcttgctccaggtgccacaaatcttcatctcaaacctcaactggatatcactgcacatcatgtggctgcacaaatattaaatttagatacaagctcagcttcattgctactgatggaacatgcgaagcagagttcttttgttttgatagcatagccagaaaaatagtaggagaaccttggggcaaccttgttacagcagttacaacttctgagagtcccagcagccctagccgctattgtgtgtct

SEQ ID NO: 37058 - DNA, 700 bp, Zea mays
  misc_feature: Ceres CLONE 1422017-F
  misc_feature: Encodes the peptide sequence at SEQ ID NO. 37059
  misc_feature (453)..(453): n is a, c, t, g, unknown, or other
  misc_feature (492)..(492): n is a, c, t, g, unknown, or other
  misc_feature (555)..(555): n is a, c, t, g, unknown, or other
  misc_feature (592)..(592): n is a, c, t, g, unknown, or other
  misc_feature (594)..(594): n is a, c, t, g, unknown, or other
  misc_feature (700)..(700): n is a, c, t, g, unknown, or other
ctggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttgggtgcagtcattggtacaaaccatcagggcacaacagctgncagcaactcgtgcttacccagtgatcagccaagtagctnctgggcaaccttttctcccctactctccagcaaccaaccatttccttcatttcaaaccaactngtctacactgaccctggctgcttattttcagcaacancnactacttacattcagccagctagctactggctactctcagcagcaacaatttcttcatttaaccaattcgccgcactgaacccctctggcttatttcagcagcaan

SEQ ID NO: 37059 - protein, 168 aa, Zea mays
  misc_feature: Ceres CLONE 1422017-F
  misc_feature (96)..(96): Xaa is any aa, unknown, or other
  misc_feature (109)..(109): Xaa is any aa, unknown, or other
  misc_feature (130)..(130): Xaa is any aa, unknown, or other
  misc_feature (142)..(142): Xaa is any aa, unknown, or other
  misc_feature (143)..(143): Xaa is any aa, unknown, or other
MAAKIFSILMLLALSACVANATIFPQYSQAPIAALLPPYLPSMTASVCENPALQPYRLQQAIATSNLPLSPLFFQQSPALSLGAVIGTNHQGTTAXSNSCLPSDQPSSXWATFSPLLSSNQPFPSFQTNXSTLTLAAYFQQXXLLTFSQLATGYSQQQQFLHLTNSPH

SEQ ID NO: 37060 - DNA, 727 bp, Zea mays
  misc_feature: Ceres CLONE 1422018-F
  misc_feature: Encodes the peptide sequence at SEQ ID NO. 37061
  misc_feature (150)..(150): n is a, c, t, g, unknown, or other
  misc_feature (390)..(390): n is a, c, t, g, unknown, or other
  misc_feature (391)..(391): n is a, c, t, g, unknown, or other
  misc_feature (399)..(399): n is a, c, t, g, unknown, or other
  misc_feature (424)..(424): n is a, c, t, g, unknown, or other
aagctggagctccccgcggtggcggccgctctagaactagtggatcccccgggctgcaggaattcgcacgagaccattacctagaacatcctaatcgaaaaatcagtcttttccaatcaatcaccagctcaaacttgtacccaaaacccntacaccggagggagagggatggtcaagaaagccgtctccaccgcgccagcagacgccgaggccgacgagcgccgccgcctccgctcgctcgccttctccaacggcctgctccagcgaggcgaccccgcggcgccgcgggcgccgctcgcgccggcggctgccgtcacgcgcctacagggccgcgacgtcgtccgccgtggcggtcagcgaaagagccgctacctcttctccttccctggnnctctcgcngcagcagccttcggtggccgggtcngagagctcgccgacctcggaaccagaaccccctgctgtacctcgaggtcccacagggaaagatgaagctcttcgggacgcacctttaccccagaacaagtaccctaagccttaaaattaaccagttcggccaggggcttccccttggaaagaacttttttaaaaccttgatttgtttttttaaaaacctgggggggggagaaaaaaaaaataattccgggaaaactctaactttttgtttcccaaaaaaatttccaaaattgtgcgcccccccccaaacggtttttttcaagggggtggccga

SEQ ID NO: 37061 - protein, 106 aa, Zea mays
  misc_feature: Ceres CLONE 1422018-F
  misc_feature (75)..(75): Xaa is any aa, unknown, or other
  misc_feature (86)..(86): Xaa is any aa, unknown, or other
MVKKAVSTAPADAEADERRRLRSLAFSNGLLQRGDPAAPRAPLAPAAAVTRLQGRDVVRRGGQRKSRYLFSFPGXLAAAAFGGRVXELADLGTRTPCCTSRSHRER

SEQ ID NO: 37062 - DNA, 626 bp, Zea mays
  misc_feature: Ceres CLONE 1422020-F
  misc_feature: Encodes the peptide sequence at SEQ ID NO. 37063
  misc_feature (181)..(181): n is a, c, t, g, unknown, or other
  misc_feature (265)..(265): n is a, c, t, g, unknown, or other
  misc_feature (267)..(267): n is a, c, t, g, unknown, or other
  misc_feature (268)..(268): n is a, c, t, g, unknown, or other
  misc_feature (270)..(270): n is a, c, t, g, unknown, or other
  misc_feature (271)..(271): n is a, c, t, g, unknown, or other
  misc_feature (274)..(274): n is a, c, t, g, unknown, or other
  misc_feature (275)..(275): n is a, c, t, g, unknown, or other
  misc_feature (284)..(284): n is a, c, t, g, unknown, or other
  misc_feature (287)..(287): n is a, c, t, g, unknown, or other
  misc_feature (290)..(290): n is a, c, t, g, unknown, or other
  misc_feature (293)..(293): n is a, c, t, g, unknown, or other
aagctggagctccccgcggtggcggccgctctagaactagtggatcccccgggctgcaggaattcgcacgagaccattacctagaacatcctaatcgaaaaaatcgcaagctcaagcaaaaacacaaagcgcttaaaccacactcaaaccaaccgccagccaacaaacaggcctcctagtnccgaccagaactcgctcgtagccccgagacccgacagcgcgagatggctcccgagctgatgacagccaagatgaccgccaaggncnncnncgnncgcgccgcngcngcngcngcaaaacctggccagagggcgtacgtgacgttcctggcgggcgacgggcactacctgaaaggcctggggggggcttgcccaagggcctcccaaagtcccctcgggctacccccctggggggggctggtttgccccaatgtccccaatccccccccggcattccttttttccaagggggttctcctcccccaaaaataaaccccctttaccccccccaaaaaaacaaaaaaatttcccccggggggaataatttttaaaaaaatccccaaagcccccccctcggggaattcggggaaaaaaaaaaaggggtgttccccggggcccaaacttttt

SEQ ID NO: 37063 - protein, 88 aa, Zea mays
  misc_feature: Ceres CLONE 1422020-F
  misc_feature (14)..(14): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
MAPELMTAKMTAKXXXXRAAAAAAKPGQRAYVTFLAGDGHYLKGLGGACPRASQSPLGLPPWGGLVCPNVPNPPPAFLFSKGVLLPQK

SEQ ID NO: 37064 - DNA, 679 bp, Zea mays
  misc_feature: Ceres CLONE 1422039-F
  misc_feature: Encodes the peptide sequence at SEQ ID NO. 37065
  misc_feature (146)..(146): n is a, c, t, g, unknown, or other
  misc_feature (212)..(212): n is a, c, t, g, unknown, or other
  misc_feature (243)..(243): n is a, c, t, g, unknown, or other
  misc_feature (293)..(293): n is a, c, t, g, unknown, or other
  misc_feature (296)..(296): n is a, c, t, g, unknown, or other
  misc_feature (313)..(313): n is a, c, t, g, unknown, or other
  misc_feature (319)..(319): n is a, c, t, g, unknown, or other
  misc_feature (328)..(328): n is a, c, t, g, unknown, or other
  misc_feature (329)..(329): n is a, c, t, g, unknown, or other
  misc_feature (360)..(360): n is a, c, t, g, unknown, or other
  misc_feature (409)..(409): n is a, c, t, g, unknown, or other
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaanatggctccaacgaccgccaccaaggacgacagtggctacggcgacgagcgccggcgcgagctgcangcgttcgacgacacgaagctgggggtgaaangtctggtggactcccggcgtcagtccatcccgtccatcttcccacacccngcngaagccctgagcgacantatttnctccggggnnctctgcggcgtcgcccgccttcgggggccgncatcccgggtgggtgaacctctccggtgaccccggccccaggaacttantccagccgggtgaagcacccggccccggaacggggggcttctttctggctgggggaacccacggattgcccgaaggaactctattggcggcaatgcttccccgggggtggcccatttcaacagggcccccccgggggagggaaaaaaaggcgccctttactcaaggggaacctcgctttgaaaacctgggggttttcccctccaattttaaaccctttttaaggggtgctgccggccccaaattgggcccaacacctttttctttccaag

SEQ ID NO: 37065 - protein, 80 aa, Zea mays
  misc_feature: Ceres CLONE 1422039-F
  misc_feature (22)..(22): Xaa is any aa, unknown, or other
  misc_feature (33)..(33): Xaa is any aa, unknown, or other
  misc_feature (56)..(56): Xaa is any aa, unknown, or other
  misc_feature (58)..(58): Xaa is any aa, unknown, or other
  misc_feature (61)..(61): Xaa is any aa, unknown, or other
  misc_feature (72)..(72): Xaa is any aa, unknown, or other
MAPTTATKDDSGYGDERRRELXAFDDTKLGVKXLVDSRRQSIPSIFPHPAEALSDXIXSGXLCGVARLRGPXSRVGEPLR

SEQ ID NO: 37066 - DNA, 674 bp, Zea mays
  misc_feature: Ceres CLONE 1422062-F
  misc_feature: SWISSPROT Homolog: EC 5.5.1.4 Inositol-3-phosphate synthase
  misc_feature (621)..(621): n is a, c, t, g, unknown, or other
aagctggagctccccgcggtggcggccgctctagaactagtggatcccccgggctgcaggaattcgcacgagaccattacctagaacatcctaatcgaaaaacacggtccacacatccaacagaggagcgcggcggaccctccttccttcctcccacttctctcgcgcggcgctcgcttacctctcctcatattccgtacgagcaggggagcggcagtgataagggagggaattaaggcaagatgttcatcgagagcttccacgacgagagcccccacgtgcggtacggaccgacggacatcgagtctcgagtaccggtacgacacgaccgagctggtgcacgaggacaacgacagcgcctcccactgagtcgtccaccccaagtccgacgagtacaacttccggaccaacaccgcgatacccaacctcctcatcatgcttgaagggtggggaggcaacaacgattccacgctgacggctggggtcattgccaaccggtaggcgatctcatggccggaccaaggaccaaggggaagtcaagccaactactactggctcccatcccccaggcattccaccattcaaagtaaggaaacttacaaccggggaaggaagatatantggagcacgcttcaaggaaccctccctaccccaatgggtgaaacccagaacca

SEQ ID NO: 37067 - DNA, 642 bp, Zea mays
  misc_feature: Ceres CLONE 1422065-F
  misc_feature: Encodes the peptide sequence at SEQ ID NO. 37068
tggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaagattcctggtttgcatccagatacaataatcagttctgtcaatattactgatgtatgggagcccattgaagaaagacttgtacccattggagatgactcggcatgtgtcaatgaaaacgaattccttggcacctaaag

SEQ ID NO: 37068 - protein, 115 aa, Zea mays
  misc_feature: Ceres CLONE 1422065-F
  misc_feature (18)..(88): Pfam Name: Alba Pfam Description: Alba
MDRYQRVEKPPPEAAAIGENEIRITTQGLVRNYVTYATSLVQEKQVKEIVLKAMGQAISKAVAIAEIIKKKIPGLHPDTIISSVNITDVWEPIEERLVPIGDDSACVNENEFLGT

SEQ ID NO: 37069 - DNA, 664 bp, Zea mays
  misc_feature: Ceres CLONE 1422066-F
  misc_feature: Encodes the peptide sequence at SEQ ID NO. 37070
  misc_feature (520)..(520): n is a, c, t, g, unknown, or other
aaagctggagctccccgcggtggcggccgctctagaactagtggatcccccgggctgcaggaattcgcacgagaccattacctagaacatcctaatcgaaaaaacttgcgtagagagttgggcgcagagaatccccaagcaaacaaacagggtagagggagaggagaggagatgagactacaggataggttgggtctgggacaccatggctccgatgaagctgtacggggcggtgatgtcctgcaacgtgacgatgtgcttaacggcgctggatgaggctggctccgactactacatcgtgcccatcatcttctttctctcccaccacaaggtcccggagtccctcgtcctctacccgttttgtttcgttccaactctgggcgttggtgacttgtacctcttcgaatccttcccaatgtttccttatgctgctcgcaaaactacggctgacctgtttacgcaaggacacctcaacgacgcagctatgtctggatgtttggatcgcttgtggaggctacanagcttgtccactgcactagatctcgtcctcgtcctcgttctcatcagtccgatgtttggctggaaccaccgactcatggctgtggatctcttccttgattatcttgactacgttcttgatgttttcgaggcactgctcattcct

SEQ ID NO: 37070 - protein, 153 aa, Zea mays
  misc_feature: Ceres CLONE 1422066-F
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (105)..(105): Xaa is any aa, unknown, or other
MAPMKLYGAVMSCNVTMCLTALDEAGSDYYIVPIIFFLSHHKVPESLVLYPFCFVPTLGVGDLYLFESFPMFPYAARKTTADLFTQGHLNDAAMSGCLDRLWRLXSLSTALDLVLVLVLISPMFGWNHRLMAVDLFLDYLDYVLDVFEALLIP

SEQ ID NO: 37071 - DNA, 652 bp, Zea mays
  misc_feature: Ceres CLONE 1422078-F
  misc_feature: Encodes the peptide sequence at SEQ ID NO. 37072
  misc_feature (379)..(379): n is a, c, t, g, unknown, or other
  misc_feature (397)..(397): n is a, c, t, g, unknown, or other
aaagctggagctccccgcggtggcggccgctctagaactagtggatcccccgggctgcaggaattcgcacgagaccattacctagaacatcctaatcgaaaagacaccccctccgctctccttatcccttccattcgcccaaacccccgccgccgtgacccctgccagcccgcggccttcccctcgttctaggcttcaactgccggcctcgtgtcttctgggcaagtgaagagagagatggcgtcgccaataccgcgcgagtgggtcgggctgcagcagtttcctccggccacccagaccgagctgcacgagctcctcggcaagctcaaggaggaggatgtgagcacattgacaattctggtgatggggaaggggcgantggggaagtcatctactngtaactccatcgtcggggagaggaatcgcactgtcagccgctttccagtctgagggtctgaaaacggatgatgtggtcgcgcacaaagggcagggtcaaccttgaacattatcgacactccttgggctttttgaaagggggataccttaatggagaaggttgtaaacctcataaaaaatttctttggggaaaaaaattgaagttcccccggatggggaacctttggaatccaacaaaagggaaaccctttaggga

SEQ ID NO: 37072 - protein, 70 aa, Zea mays
  misc_feature: Ceres CLONE 1422078-F
  misc_feature (48)..(48): Xaa is any aa, unknown, or other
  misc_feature (54)..(54): Xaa is any aa, unknown, or other
MASPIPREWVGLQQFPPATQTELHELLGKLKEEDVSTLTILVMGKGRXGKSSTXNSIVGERNRTVSRFPV

SEQ ID NO: 37073 - DNA, 639 bp, Zea mays
  misc_feature: Ceres CLONE 1422085-F
  misc_feature: Encodes the peptide sequence at SEQ ID NO. 37074
aagctggagctccccgcggtggcggccgctctagaactagtggatcccccgggctgcaggaattcgcacgagaccattacctagaacatcctaatcgaaaactttcctttccctacggcggcggcgctggagcagctaagcagcagcaagatgttcgacggcttcaatctccgcttccgccgccagagcgccacccttggctgcgccatgactttctccatctacctgcccccgtccccggtgtccaaccttcccgtgttgtactggctctcgggtctcacctgcaccgaggataatttcatcataaagtccggcgcccagcacgccgccgctgcccacggcatcgccctcgtggcacctgacacctccccacttatcttctgcatgatggattcatttgatggaactattttaggcctctgattgcggaatacagatcgatttgcttgtcacaaggataaagcagatccacgatgagtagaagcgtgggcatccaaatgaataaccaggggagagcagtctaaggcaaatttgctaggctggagcagtcacaagagctagggactacagtcataggtcctgctagccagggtggagcagtcataagacctcctagcagtccaaggcaaatttgctagg

SEQ ID NO: 37074 - protein, 90 aa, Zea mays; identical to SEQ ID NO: 18079
  misc_feature: Ceres CLONE 1422085-F
  misc_feature: SWISSPROT Homolog: EC 3.1.2.12 S-formylglutathione hydrolase

SEQ ID NO: 37075 - DNA, 621 bp, Zea mays
  misc_feature: Ceres CLONE 1422086-F
  misc_feature: Encodes the peptide sequence at SEQ ID NO. 37076
aaagctggagctccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgactctggtgggcaagcgacgccgacagcagtgatggca

SEQ ID NO: 37076 - protein, 145 aa, Zea mays
  misc_feature: Ceres CLONE 1422086-F
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEDGRSGGPADDDSGGQATPTAVMA

SEQ ID NO: 37077 - DNA, 706 bp, Zea mays
  misc_feature: Ceres CLONE 1422094-F
  misc_feature: Encodes the peptide sequence at SEQ ID NO. 37078
agagctggagctccccgcggtggcggccgctctagaactagtggatcccccgggctgcaggaattcgcacgagaccattacctagaacatcctaatcgaaaaatcactctctctcctctcctcgcctctccttggtgtccgtgttcatccctgcactagccggtggcaccgcgataccttcggccctccccagcacccggctcggggcgtcgacggcgcaccgcgctgctacccacggaagcgcccacaccaccaccacgtgacatgaacggcgaactcgagaagaacacaccctccactaacgaaccctagcgacggtcgcctactaccggtgacattgtccccctgcggtccctcctcgcataccctactcaccgtcgccagcctgcaggaagcctattcgagacaagggctaactttcctgccgtggcgagcttccgccgaatcaacgtcgatcatgaccgccggccactaaatagagcaacacacaacccttcaaatcactggagacctctgcatcaaccccgacgcggccgccacagcagggcggccacttcccccatcgccatcgctcctcgacatccgttgaggcttgtgtaggccagcgcgcgcagactcaccatgacgcaagcactgcctcccgatctgaagcagccgcccagggagcaagtggggtgggccagccccttgcctgagcggtgcctag

SEQ ID NO: 37078 - protein, 28 aa, Zea mays
  misc_feature: Ceres CLONE 1422094-F
MTQALPPDLKQPPREQVGWASPLPERCL

SEQ ID NO: 37079 - DNA, 677 bp, Zea mays
  misc_feature: Ceres CLONE 1422119-F
  misc_feature: Encodes the peptide sequence at SEQ ID NO. 37080
aaagctggagctccccgcggtggcggccgctctagaactagtggatcccccgggctgcaggaattcgcacgagaccattacctagaacatcctaatcgaaaactattccttcgcttccgtcaggtcgggtccgcagcctccccctctcgcagatccccacctgctcctccgccggccaccgcgttgctcccctcggcagccaggatgacagaagtaccatttctgccgcgtgagaggctcttcaagcagcaacattacttccagaacttgaccaagcacacctacctgaaagggcgctacgacgtgatcacctccgtcgccatcccccttgcactcgctgcctccagcatgttcatgattgggcgtggagtttacaacatgtctcatggggttgggaagaaagagtgatcttccactggttaactattgtttctgcttggcatggaagtcataccgtcgagactgcgaagtcctcttcgcttgcaaaataatacggccaaataacaattcgactacattttcgcatcaattttctgtttgtatttgcgggtgtgaagtggcagtaacttgaaaatcagcactgtcactgttttgggtagttacatcaatccctttcctccttttgggccccctttcaaaaaaaaaccggggccctttgtccaaaaaaaaaaaaaaaa

SEQ ID NO: 37080 - protein, 67 aa, Zea mays
  misc_feature: Ceres CLONE 1422119-F
  misc_feature (9)..(62): Pfam Name: COX7a Pfam Description: Cytochrome c oxidase subunit VIIa
MTEVPFLPRERLFKQQHYFQNLTKHTYLKGRYDVITSVAIPLALAASSMFMIGRGVYNMSHGVGKKE

SEQ ID NO: 37081 - DNA, 672 bp, Zea mays
  misc_feature: Ceres CLONE 1422126-F
  misc_feature: Encodes the peptide sequence at SEQ ID NO. 37082
tccccgcggtggcggccgctctagaactagtggatcccccgggctgcaggaattcgcacgagaccattacctagaacatcctaatcgaaaaaaaccgtgacgcagcgcagccatggggaagcagctctgcgacatgcaccgctcgcgccgccgcgcccgcatcgtcgccgccgccctcctctccgccttcgccgctgctgccgccgcgctcacggagtacctcgtcttccgtccgctgaagccgcaggcctccgtggtgcgcgtcgacgtgtaccgcatggccacggccgccgggaactcctcggaggggcgggccccgccgccgtacacgctcgcggcgagcgcgcggttcacggcgctgctgcacaacccgagcgaccgcgccgtggtgttctaagacgggctcttcgcctacgtgacctacccccgggagatggtggcgccgccagagactctgcccggggtggaacagggccgcggggccgaagtggcgctggttgccccattttcggccttggcatcaagaagcaccgtggcggttgtagggcgaaaccgacgaaggcccatggtgggccaacagcccggcggggactttatgaaagcttggccctctgttatcatgtgcgccgcgtccaagaacaattgagggggaaattttaatacaacgggacg

SEQ ID NO: 37082 - protein, 94 aa, Zea mays
  misc_feature: Ceres CLONE 1422126-F
MGKQLCDMHRSRRRARIVAAALLSAFAAAAAALTEYLVFRPLKPQASVVRVDVYRMATAAGNSSEGRAPPPYTLAASARFTALLHNPSDRAVVF

SEQ ID NO: 37083 - DNA, 605 bp, Zea mays
  misc_feature: Ceres CLONE 1422132-F
  misc_feature: Encodes the peptide sequence at SEQ ID NO. 37084
  misc_feature (314)..(314): n is a, c, t, g, unknown, or other
caaagctggagctccccgcggtggcggccgctctagaactagtggatcccccgggctgcaggaattcgcacgagaccattacctagaacatcctaatcgaaaaatcgatccagtgcaaacaagctcgctcgcaagcgcaacccacccacgtctaccacacgaagcatcgtagccagccacccatccagccagctaaacccacacatggccgggatcgtggtggtgttcgacttcgacaagacgatcatcgacgtggacagcgacaactgggtggtggacagcctcggcctcaccgacctgttcgagcgcctccntccccacacgccctggaacacgctcatggacacgatgatgggggagctgcacgcgcggggcaggacgctggccgaagtgaccgaagcgctcagggcggcggccatcgaaccgcgcgtgcccgccgccgtcaagggcgccgcacgccctccggtggcgacctgcggcggggtcagggaacccaaagcctttctttatcccaacccgttctgggaccacccaggggcttggttaaaatggtttttccccaaaataaaaaccaaacccccagcccgggttgaaaccccccaggg

SEQ ID NO: 37084 - protein, 133 aa, Zea mays
  misc_feature: Ceres CLONE 1422132-F
  misc_feature (4)..(121): Pfam Name: Put_Phosphatase Pfam Description: Putative Phosphatase
  misc_feature (37)..(37): Xaa is any aa, unknown, or other
MAGIVVVFDFDKTIIDVDSDNWVVDSLGLTDLFERLXPHTPWNTLMDTMMGELHARGRTLAEVTEALRAAAIEPRVPAAVKGAARPPVATCGGVREPKAFLYPNPFWDHPGAWLKWFFPKIKTKPPARVETPQ

SEQ ID NO: 37085 - DNA, 692 bp, Zea mays
  misc_feature: Ceres CLONE 1422133-F
  misc_feature: Encodes the peptide sequence at SEQ ID NO. 37086
aaagctggagctccccgcggtggcggccgctctagaactagtggatcccccgggctgcaggaattcgcacgagaccattacctagaacatcctaatcgaaaatttcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgataatctgaatgtgtggaggacccttttcttctagattttatcttcagctgtccttgtaagggttgtgttcaggttgagagttagcaggttgagctgtctatctgagaccatttaaagtctctgagttttggtgttatggatcactggaagtattatatgaagtttaagttagaactaatttgtttgccatact

SEQ ID NO: 37086 - protein, 101 aa, Zea mays
  misc_feature: Ceres CLONE 1422133-F
  misc_feature (12)..(101): Pfam Name: Ribosomal_L35Ae Pfam Description: Ribosomal protein L35Ae
MVKGRTGQRVRLYVRGTVLGYKRSKSNQYETTSLVQIEGVNTKEDVAWYCGKRMAYIYKAKTKSSGTHYRCIWGKVARPHGNSGVVRAKFRSNLPPESMII

SEQ ID NO: 37087 - DNA, 715 bp, Zea mays
  misc_feature: Ceres CLONE 1422139-F
  misc_feature: Translation starting site: 244
  misc_feature (408)..(408): n is a, c, t, g, unknown, or other
aaagctggagctccccgcggtggcggccgctctagaactagtggatcccccgggctgcaggaattcgcacgagaccattacctagaacatcctaatcgaaaaagatccacaacaaatagcgaaaccctagcccaaactcgaccgcctctgctataagtagctccactctctctcctccaagcctaccccagccgccgccgccgccaccgccacctgccccagcgcgccgccgccgcagccaccatgggtcgcgtccgcaccaagaccgtgaagaagacctccaggcaggtgatcgagaagtactactcccgcatgaccctcgacttccacaccaacagaaggtgctcgaggaggtctcgattctgccctcgaagcgcctccgcaacaggtggctgggctcagtaaccnactgatgcgcgcatccagggcggccaagtcgcgggatctccttaaccttccagaggaagaaccaagcccccaatggacttcggcccaaaaaacccccccccggggcaaaaaaatccggtcaaaaaaaaacctggaaaaaccccctccccccgaaagggccaaacttcccgggtttaaccccccgttaaggtttccaacccccccccataggcgccccaaaaaaggggggccccccccggaccccctttaaaaaccccggggggtggccctttaaaaccccctattaaaagggggggcccccacaaaa

SEQ ID NO: 37088 - DNA, 827 bp, Zea mays
  misc_feature: Ceres CLONE 1422149-F
  misc_feature: Encodes the peptide sequence at SEQ ID NO. 37089
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gggggcccccaaaacaataataaacccccggttnnnnnnnnnnnnnnnnntcaaactggagctccccgcggtggcggccgctctagaactagtggatcccccgggctgcaggaattcgcacgagaccattacctagaacatcctaatcgaaaaaggcatacaagtgtcacgtcgccggtccctcgcgaagcctacagccgcagcagcacactcccgcaggagcagcagccgccgccgccgccgcccagccgcaggaaacaggaggaagatgccggcggggcacgggcttcggtcgcgaacccccgacctgttcgcgcggccgttccgcaagaaggggtacatcccggtcaccacggacctgcgcacctacaataccggcgactacctgcacctcaaggagaacggccccctgcacaagggcatgggggaaaaggtgggccgaggccaccccggccgcgtgtgggaaggtcaacaaccgcgccagcggcgggcaagattcaggcagcaggactaatggccccgcaaggaacgaggaacgcggagcccaatgcccgggggggcgaggcatgaaccaagccagggcccgcttctcccaggaagaggtttccgcgcctggaggaagaagcctaagaggcgagtgagccctcgagggtgggaatgcccctaggcagcgagggggccccgtcttgaaccagccgccccagaacgggcccccctggggggtaggcggggggcccgtggaagtcgaaggcctccgagcgaaagccatatcccgtgggagcgtcgcgcaatatcaccattgccccctcctacaacctccggagaag

SEQ ID NO: 37089 - protein, 81 aa, Zea mays
  misc_feature: Ceres CLONE 1422149-F
  misc_feature (2)..(81): Pfam Name: Ribosomal_L21e Pfam Description: Ribosomal protein L21e
MPAGHGLRSRTPDLFARPFRKKGYIPVTTDLRTYNTGDYLHLKENGPLHKGMGEKVGRGHPGRVWEGQQPRQRRARFRQQD

SEQ ID NO: 37090 - DNA, 714 bp, Zea mays
  misc_feature: Ceres CLONE 1422150-F
  misc_feature: Encodes the peptide sequence at SEQ ID NO. 37091
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccattacctagaacatcctaatcaaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcaaggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37091 - protein, 151 aa, Zea mays
  misc_feature: Ceres CLONE 1422150-F
MAAKIFCLLMLLGLSASAATATIFPQCSQAPIASLLPPYLSPAVSSVCENPILQPYRIQQAIAAGILPLSPLFLQQSSALLQQLPLVHLLAQNIKAQQLQQLVLANLAAYSQQQQFLPFNQLGSLNSASYLQQQQLPFSQLPAAYPQQFHG

SEQ ID NO: 37092 - DNA, 637 bp, Zea mays
  misc_feature: Ceres CLONE 1422161-F
  misc_feature: Encodes the peptide sequence at SEQ ID NO. 37093
aagctggagctccccgcggtggcggccgctctagaactagtggatcccccgggctgcaggaattcgcacgagaccattacctaggacatcctaatcgaaaaaggagcccagtcaatgagcttagcacttctcgagggctactcctccgccgaggaggaggacggccccgccgccggcgccggcgccgagctaagcgagtccgctgattcgtcagccgaggaagccggatcggacggcgacgaggggtccgctcctccgaagtcggccttcaagccccgccgccgaccaaaccgtaagaagggagatgccggcggcggcgacggggactcctgtctgccctccgctctggaggccttctccgatatctcgggaccaccggagttcttgaggcacagggttgcggagcctgaggaagggacggaggccctcggtgtactcgatcgccgtgggaaagaggggagcaagctgccgcctccaggagctgttgtggtggcaaaaccgcagttggttaccacaattggagccaaccctccaggttcagtgacatctggttctgttgatggaaaaagaataataggtgccgcaaatcctggtccagaagatgcagctgatcttctgaggatgtgtctccaatgtg

SEQ ID NO: 37093 - protein, 174 aa, Zea mays
  misc_feature: Ceres CLONE 1422161-F
MSLALLEGYSSAEEEDGPAAGAGAELSESADSSAEEAGSDGDEGSAPPKSAFKPRRRPNRKKGDAGGGDGDSCLPSALEAFSDISGPPEFLRHRVAEPEEGTEALGVLDRRGKEGSKLPPPGAVVVAKPQLVTTIGANPPGSVTSGSVDGKRIIGAANPGPEDAADLLRMCLQC

SEQ ID NO: 37094 - DNA, 626 bp, Zea mays
  misc_feature: Ceres CLONE 1422166-F
  misc_feature: Encodes the peptide sequence at SEQ ID NO. 37095
aaagctggagctccccgcggtggcggccgctctagaactagtggatcccccgggctgcaggaattcgcacgagaccattacctagaacatcctaatcgaaaaactactctctctctctctgcctgcaaagctgcttgatacatcatcgatcacgtcactccaccagccgcagcgcacgaacgtacgactcatggcagatcgcgaccgcagcgacatctacggcggcggcgcctacgggcagcaccacgggggcggccacccgatgggtgagcaggagaaaggcatgatccacaacaaggggccgacggcgtcccaggcgctgaccgaggcgacgctggtccctctgggcgggactgctcctgatgctgtcgggcctggcgctggcgccctccacggtggggctggccctggtcacgcccgtgttcctgctcttcagccccgtgctcgtccccgccgcgatgctcatcggcacggtcgtcgcggggttcctcacatcgggcgcgctggggctcggctgcctgtcctcgctcacgtgcctcgccaacacggtgcggtaggtgttccagctcacccaagactacctctaggaggcgcgccgcacgatggctgacgccgaggagcacgcg

SEQ ID NO: 37095 - protein, 64 aa, Zea mays
  misc_feature: Ceres CLONE 1422166-F
  misc_feature (1)..(65): Pfam Name: Oleosin Pfam Description: Oleosin
MLSGLALAPSTVGLALVTPVFLLFSPVLVPAAMLIGTVVAGFLTSGALGLGCLSSLTCLANTVR

SEQ ID NO: 37096 - DNA, 767 bp, Zea mays
  misc_feature: Ceres CLONE 1422197-F
aagctggagctcaccgcggtggcggccgctctagaactagtggatcccccgggctgcaggaattcgcacgagaccattacctagaacatcctaatcgaaaagtcaacgttctcccgtccccccgagcgcagtctcgcgtggttctcccgtccccccccccgtgccgtggttctccaatcctccctcatccgctctctttctttctctctcgtggcgagtggtaaccatctccggtgctcaggtcttgttcccgaccttcgccggggactagccttggccaaatggatcttggagcccaagtcatgttccatcatcccccttggtgctctgtttgttctcccccacttctccctttccagcctcctgccgcgtacccaccatccccacacctggcgccccggtggcccttctggtcgcgtccccgtaccatttcccccccttttccgccatcctttgttcatggcagttcttttttcccaaaaacccctctctctcttatttttaagataaatatagttgtgctttgtagcaccccgcccctcccactggtatttcggatccttcttcctgccgccgcccctagtcgcactctcgccccccttccctcgtggccctgccttgtggccgatttcgcccgctacccccttgcgccacccgttgcttttttttccataaaattttcgtttccctttccccccccatccgcaccattttgcctccgcctgtgtttcccccttctttctcttttctccttcccccccccactc

SEQ ID NO: 37097 - DNA, 648 bp, Zea mays
  misc_feature: Ceres CLONE 1422204-F
  misc_feature: Encodes the peptide sequence at SEQ ID NO. 37098
aaagctggagctccccgcggtggcggccgctctagaactagtggatcccccgggctgcaggaattcgcacgagaccattacctagaacatcctaatcgaaaattgtttgtttgtttgatgagaaagcgcaaacgggagagaaaccctagctggctagctctcccgcctctctataaatcagcgcagcctgttcgtacagcgccacacaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatcctacgtcccgccgccgggccagcccgtgatcgtcgtccagggcgtcatctactgcaagtcctgcaagctcagggggctacacagcggcatggacgcgtcccctctccccaatgcgaccgcgaggcttgtgggctaccgcgaccccgaggagcagtacggggtgctggaacag

SEQ ID NO: 37098 - protein, 112 aa, Zea mays
  misc_feature: Ceres CLONE 1422204-F
MASLKDHCAVVAVVVAICFVVLAAALPSHASTAVDEPAKYKPSRAPAPSPASASSYVPPPGQPVIVVQGVIYCKSCKLRGLHSGMDASPLPNATARLVGYRDPEEQYGVLEQ

SEQ ID NO: 37099 - DNA, 719 bp, Zea mays
  misc_feature: Ceres CLONE 1422220-F
  misc_feature: Encodes the peptide sequence at SEQ ID NO. 37100
aagctggagctccccgcggtggcggccgctctagaactagtggatcccccgggctgcaggaattcgcacgagaccattacctagaacatcctaatcgaaaaaaaccgttcgtctagcttggctgttggttcgtccctgtccggtacccttctctcaactctcaagccgcgcagttgtcgaagtcgaaactatccgctgctgtagtagagatgctctcgatgcggccacccagcaccaccttgtcccgccggccgagacggggtcgcctcgggggagccgccgcgccgcaatatgttagcgctgcggcaccggcgcccgctctggagccagctgcgcctccggagagcgtctcctttccgattctggtgaatggctgcactggtaacatggggttatctgtcgctgaggctgctgctctgaggggccttcacctagtccctgtttcattcagcagtagagagaaggttgaaaaaacaatgcaagttggacaaacagacattcaaatatatggtccttctaaaagagaagatgttctttcatctattgctgatgaattcccagatgtcattgttgtggactacacaggacccggttctgtgaactctaatgctgagctctattgcaagcttggattgccatttgtgatgggcacaactggtgggaacaagcatttgctctacaagtcagtgcaagattcaaaaaattatgcactaatatct

SEQ ID NO: 37100 - protein, 111 aa, Zea mays
  misc_feature: Ceres CLONE 1422220-F
  misc_feature: SWISSPROT Homolog: EC 1.3.1.26 Dihydrodipicolinate reductase
MGLSVAEAAALRGLHLVPVSFSSREKVEKTMQVGQTDIQIYGPSKREDVLSSIADEFPDVIVVDYTGPGSVNSNAELYCKLGLPFVMGTTGGNKHLLYKSVQDSKNYALIS

SEQ ID NO: 37101 - DNA, 696 bp, Zea mays
  misc_feature: Ceres CLONE 1422228-F
  misc_feature: Translation starting site: 208
  misc_feature (467)..(467): n is a, c, t, g, unknown, or other
  misc_feature (493)..(493): n is a, c, t, g, unknown, or other
  misc_feature (534)..(534): n is a, c, t, g, unknown, or other
aagctggagctccccgcggtggcggccgctctagaactagtggatcccccgggctgcaggaattcgcacgagaccattacctagaacatcctaatcgaaaactctgctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccctgaccagcacggcatcgcgcttgtcaagagcgtgactggtagcaagatcctccgcatcctcaaggcccatgggttgggcgccgggagatccgggangatctctacttcctcaataagaagcnggggcgattaggaagcatttggagaggaacaggaaggacanggacctcaaattccgacctcttcctggttgaaagaagatacacccgccttgcccgcttataaaagggtaaccaaaagctcccccccccctggaagtacagatcaacttcgggaacccctgggggcaaaggatacccccagtggttggtttaaccccttaagg

SEQ ID NO: 37102 - DNA, 653 bp, Zea mays
  misc_feature: Ceres CLONE 1422232-F
  misc_feature: Translation starting site: 196
  misc_feature: SWISSPROT Homolog: EC 1.2.4.1 Pyruvate dehydrogenase (acetyl-transferring)
atagctggagctccccgcggtggcggccgctctagaactagtggatcccccgggctgcaggaattcgcacgagaccattacctagaacatcctaatcgaaaaataatttcccctcattcatctcacagtcccaggcctcccctccctcctccccgtcgccaagcaacctccaacccccagccgatcgcgtcggagatgctgggcgtcgcgcggaggcggctcggatccggatgcgtgctcgtccagttggcgcaggacctccgacccgccgacgctcccgccaggacctactccgtcgcgggcgaggagataactgcacgggaagcattgcataccgcattagatgaagaaatgtcggcacacacttctgttatcttgatgagagaagaggttcgcgagcacaacgagcatacaagatatcgaggcgttgcatgacagaatgggccctagagggttctcgatactccgatcactgacgcgggcttcactggcagttggagttcgcgccagataccatggtcttcaacctattgtcgagctcatgaccttttacttttccatgcacgccactgatcaccccattaaatcagcgtgcgagccgaactacatgtctgctggggaggaaacagatcccatttgccttaggggtacca

SEQ ID NO: 37103 - DNA, 654 bp, Zea mays
  misc_feature: Ceres CLONE 1422235-F
  misc_feature: Encodes the peptide sequence at SEQ ID NO. 37104
aaagctggagctccccgcggtggcggccgctctagaactagtggatcccccgggctgcaggaattcgcacgagaccattacctagaacatcctaatcgaaaacatttaaccaataagcattcattcattagtctcagccagtcgagctcgtcggtcgccatcgccacctctaaccgccgccgtcgccgccggcccgcagtggtgccacaaaaccggtgacccctactccccctctttcctctcccctctctcccgctctgcctctcccttcgccacttctaccctgctgagggtgtcgcctatggatctcccccgtcctccgtgtgggtgcgcagcggcggtggtgcgcctggcggcagctgatgcgcacaacaaagtgttccctagttaagtgtgccgagccggaggggatggcagtcgacgcagctttgcggctgttgtggcaaccggtgcgtcggtgcccctctggagggggttgcgcagaggctagggcagtggagacggcggaggctacctgctttgacctggggatcctggctttcgatgtgctggatggcatcttggggcgaaaaccttggcgatggtgacatccgtggacgccactttccccctgttgagggcgtcgcattgctatgtcctccaattcgtcttgac

SEQ ID NO: 37104 - protein, 74 aa, Zea mays
  misc_feature: Ceres CLONE 1422235-F
MRTTKCSLVKCAEPEGMAVDAALRLLWQPVRRCPSGGGCAEARAVETAEATCFDLGILAFDVLDGILGRKPWRW

SEQ ID NO: 37105 - DNA, 647 bp, Zea mays
  misc_feature: Ceres CLONE 1422237-F
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaactagttcccatccattggtgtggacgtgtcacgtgtggtggttgcgttgcggggccccgatttcgagcgggtgttcaattttggtgccggatttttaaggaggatccaatttaggaagaattttggttttggggacaatggttttggactgcctgatattcgattcataggttggtcaaacgctttggagtagagaatttttttcccggaaaagaagagccatttttctagttgtgctactcgtcaatcaatccagtgaagctgaactctggaagaagaaactttcctaattagacccggtatttcgtggttggccgttggcgtctaaagtctaatttatttgtcgcgttttagtttaaaaatgaacatatttttctgtttactccgcccaaaatctttccgctggatctacttgtgaatcgggtttgtttgttttttatctgagctattcttgttgatttangatttcgatttcgcagatcaaggggacgcccgattttgcctgatttcttcgcaattttggtccgatcaagaagctccagccc

SEQ ID NO: 37106 - DNA, 645 bp, Zea mays
  misc_feature: Ceres CLONE 1422242-F
  misc_feature: Encodes the peptide sequence at SEQ ID NO. 37107
atagctggagctccccgcggtggcggccgctctagaactagtggatcccccgggctgcaggaattcgcacgagaccattacctagaacatcctaatcgaaaagatatctcattggagtgcaggactcggaggcagcccatttctaggcagcgccgtctcttcgcacaccccccaattcgaacgacggagcacgacgcacgcagagccgcagagatccgtcacactgcaagttttgaaaactgaactgtaagatggcatccgcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaagaggagggtcgagggaatgaggaccgggtaacactcatcaagggaacaccgtggcaagattgaaactgagctcacccagatctggggatgggatccgcaagcttctcgaatctcaccttggggcgtcttccaccgctccggagtccaagggccttcctcctcaagatgg

SEQ ID NO: 37107 - protein, 95 aa, Zea mays
  misc_feature: Ceres CLONE 1422242-F
MASAELSREENVYMAKLAEQAERYEEMVEFMEKVAKTVDSEELTVEERNLLSVAYKNVIGARRASWRIISSIEQKEEGRGNEDRVTLIKGTPWQD

SEQ ID NO: 37108 - DNA, 722 bp, Zea mays
  misc_feature: Ceres CLONE 1422245-F
  misc_feature: Encodes the peptide sequence at SEQ ID NO. 37109
aagctggagctccccgcggtggcggccgctctagaactagtggatcccccgggctgcaggaattcgcacgagaccattacctagaacatcctaatcgaaaaaacacgcgcacatgtgacatgccccatggtcgtcgccgctccaggcatcctcccgtggcctcacctccctctcccttcctcctcccacccgtctgacgcctctgacgccgccgcagcagcaacagacgccaacacctccgcgtatgacatccagatcttcgagcccacctccatcgaggagcgtcgtcgcctcctgatccagcggcgtcgcctccgactcgccgcctcccatgcctcgcggctcaccgttgcctcgcgcgtctcctccaaactcatcagcaccactgcctcctgctccagcggcgtcgcatccgatctgccgcctcccctcctcatggctcgtcgttgcctcccgcctcttccccaacctcgcccttgccgcccttggaggatcccaaatccgacgacgagctcagtaggcccacgcagacgcggatgtgctatgaacttcagacaacatattcctaccgagaagtatgaaaagtacacttcagagcatgtcaaggtcctcacgaaagcttcctatcaagtggttgtttgcaagattgacgagttgtaggcaccaaatatatcgagtccttgctatcaacatatgagcatattattgtcaaactcaagcgt

SEQ ID NO: 37109 - protein, 38 aa, Zea mays
  misc_feature: Ceres CLONE 1422245-F
MNFRQHIPTEKYEKYTSEHVKVLTKASYQVVVCKIDEL

SEQ ID NO: 37110 - DNA, 724 bp, Zea mays
  misc_feature: Ceres CLONE 1422248-F
  misc_feature: Encodes the peptide sequence at SEQ ID NO. 37111
tggagctccccgcggtggcggccgctctagaactagtggatcccccgggctgcaggaattcgcacgagaccattacctagaacatcctaatcgaaaagacacccttgctcgcccgcatctctctaaccgccggcgccggcgccggcgccggccatcgttcacatggctgcgatgccaccggccttcacgggcaacctgaagaaagcacttgcaggtctgagaagatcaatttagatgggcttcgatggcgcgtatttgatgctaagggtcaggtgctgggacgattggcttcccaaatagccgttgtgcttcaaggcaaggataaaccgacctatgcgccacatgtggaaaatggagacatgtgcattgtacttaatgcacaggatatcagtgttacaggaaggaaaatgacagataagatttactactggcatacagggtatgtttgccatttgagggaaaggaggcctcaggacccagatggagaaagacccaactgaagtgattcgcaaagctgtgctgcgcatgctttccccgcaacaaactgcgtgatgatagggatcgcaagctgcggatattttcctgaatgaagcatccattccatgaccgccctcttgaaactttttgtgatgccaccccggcaaatacgggaaatgccaccccgtgcaaggccgtgcattgtaagggccaaaaaaaaaaaccattcaaacgggcgcaaagaaga

SEQ ID NO: 37111 - protein, 46 aa, Zea mays
  misc_feature: Ceres CLONE 1422248-F
MCIVLNAQDISVTGRKMTDKIYYWHTGYVCHLRERRPQDPDGERPN

SEQ ID NO: 37112 - DNA, 646 bp, Zea mays
  misc_feature: Ceres CLONE 1422254-F
  misc_feature: Encodes the peptide sequence at SEQ ID NO. 37113
aagctggagctccccgcggtggcggccgctctagaactagtggatcccccgggctgcaggaattcgcacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggct

SEQ ID NO: 37113 - protein, 115 aa, Zea mays
  misc_feature: Ceres CLONE 1422254-F
  misc_feature (16)..(115): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKA

SEQ ID NO: 37114 - DNA, 646 bp, Zea mays
  misc_feature: Ceres CLONE 1422266-F
  misc_feature: Encodes the peptide sequence at SEQ ID NO. 37115
  misc_feature (590)..(590): n is a, c, t, g, unknown, or other
  misc_feature (628)..(628): n is a, c, t, g, unknown, or other
atagctggagctccccgcggtggcggccgctctagaactagtggatcccccgggctgcaggaattcgcacgagaccattacctagaacatcctaatcgaaaaatgtagctctttctggtcccaggagaacgagccgctcgctgatgtgggagcttgtcagcaccgtggatcgcccaaacggccagacgtgatgtctcgcccacgtgtcccttgcccctgtccacctgtcccctccggagcctgcaaagaactcccctccccgctatcatttccggcgcagaaaaggagagtaacactcaacactgcagaaatcagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgctggcgctggtgggccgcgtggcngtagcgagcaacgcgtcgggtgggcacgtcaaccctgncgtcacgttcgggctgct

SEQ ID NO: 37115 - protein, 95 aa, Zea mays
  misc_feature: Ceres CLONE 1422266-F
  misc_feature (90)..(90): Xaa is any aa, unknown, or other
MLPGRHPARRADATGTGPLLPDATRAVVAEFVATAMFVFAAEGSVYGLWKLYKDTATPGGLLAVAIAHTLALVGRVAVASNASGGHVNPXVTFGL

SEQ ID NO: 37116 - DNA, 685 bp, Zea mays
  misc_feature: Ceres CLONE 1422272-F
  misc_feature: Encodes the peptide sequence at SEQ ID NO. 37117
  misc_feature (51)..(51): n is a, c, t, g, unknown, or other
aagctggagctccccgcggtggcggccgctctagaactagtggatcccccngggctgcaggaattcgcacgagaccattacctagaacatcctaatccaaaaacgctgagccgtcgttgtcgctgggattgcagcagcgttggcgggccttgtggcgaggaggaggaggagaaggagggggcgtggaggcgcggcgattgttcgcgggatgagctacggcggcagcagctccctcgcgcccggtgccaagaggccgttcgagtacgggagaacgcatgtggtgaggcccaagggcacgcacaaggccaccattgtctggctccacggacttggggacaatggaaccagctggtctcaactgctggaaacgctcccccttcctaatataaaatggatatgcccaactgcaccttcaagacctgtgtcatttgttgggcgggttccccctgcacagcatgggtttgatgttgctgacctttctgagaatgctcccaaagaaccctgagggaatggatgccccccccgccattggtggaaattttgttgcaactgaaccccctgacatcaacttgggggtgggggggcttaagaagggggggggcaaagggccctggaccccggaaccctgcttttgcccccgggaaaaaatggggaaccgggaatccccctcccccgggggaaacca

SEQ ID NO: 37117 - protein, 98 aa, Zea mays
  misc_feature: Ceres CLONE 1422272-F
  misc_feature: SWISSPROT Homolog: EC 3.1.1.1 Carboxylesterase
MSYGGSSSLAPGAKRPFEYGRTHVVRPKGTHKATIVWLHGLGDNGTSWSQLLETLPLPNIKWICPTAPSRPVSFVGRVPPAQHGFDVADLSENAPKEP

SEQ ID NO: 37118 - DNA, 782 bp, Zea mays
  misc_feature: Ceres CLONE 1422273-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (89)..(89): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (109)..(109): n is a, c, t, g, unknown, or other
  misc_feature (110)..(110): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (185)..(185): n is a, c, t, g, unknown, or other
  misc_feature (188)..(188): n is a, c, t, g, unknown, or other
  misc_feature (189)..(189): n is a, c, t, g, unknown, or other
  misc_feature (364)..(364): n is a, c, t, g, unknown, or other
  misc_feature (365)..(365): n is a, c, t, g, unknown, or other
  misc_feature (416)..(416): n is a, c, t, g, unknown, or other
  misc_feature (446)..(446): n is a, c, t, g, unknown, or other
  misc_feature (535)..(535): n is a, c, t, g, unknown, or other
  misc_feature (651)..(651): n is a, c, t, g, unknown, or other
  misc_feature (660)..(660): n is a, c, t, g, unknown, or other
  misc_feature (662)..(662): n is a, c, t, g, unknown, or other
nnnnnnnnnnnnnnnnnnnnnnnnnnnnnnnnnnnnnnnnnnnnnnnnnnnnnnnnnnnnnnnnnnnnnnggggggnnnnnnnnngggnccccnnnncccccnnngggnnggggnnnnnnnnnnnnnnnnnnnnnnnnnnnnnnnnnnnnnnnccaannnnnnnccaaagctggaaactccaccncgnngtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaacaccacaaccagnncggctcccccggcgtcggggcccccaaacaaagggtggttcaaaagaatcntcctgcccgcggccaaaacgaaaaaaaatntactggcccttgggccgttccccgcaaaaaggggccccctttctttggcttgggcccccccgggtaaaaccccccccccaaagggaagngagaaacccccccccccgggggccccctgggggggaaaaacaaaaggaaaaaaaagggggccctttttaaaacaaaaacaccccgcggggggtgtcccaaaagggggggcccacanaaaaaaaananaaagagggggggggcttttttttccccccccccccgggggcggtttgttttttttcggccgccccctccccttttttttttaaaaaaaaaaaaaaaaaaaaggggcccccccccgcccgc

SEQ ID NO: 37119 - DNA, 732 bp, Zea mays
  misc_feature: Ceres CLONE 1422276-F
  misc_feature: Encodes the peptide sequence at SEQ ID NO. 37120
  misc_feature (642)..(642): n is a, c, t, g, unknown, or other
aagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcatcaccgcgcctcccgggcagccgaccacggtagcgtccgaggtgctggacatgggcgcggcggcgatgcagtcgttgcgccccgtgaagcaggcgaagcagcacatgtgcacgttcgcgctgtacgcgcactacccgaagcggcaggtggagacgcaccactacgtctcccgcctcaaccaggacttcctccagtgcgccgtctatgactcccacaaagccgacgcgcgtctcatcggcgtggagtacatcgtgtcaaggaagatcttcgactcgctgccagcggaggagcagcggctgtggcactcgcacgcgcacgagatcaagtcaggcctgtggacgagcccgcacgtggcgaggctgctcgagaaggcggagctggaccacatggccgccacgttcggcaagttctggtgcacctggcnagtggaccgctgcgaccgtctgacgctgggcgcccccgcgctcatggtgtcaccgcaatcctacctcgccgcagccgtgcgaccctacct

SEQ ID NO: 37120 - protein, 192 aa, Zea mays
  misc_feature: Ceres CLONE 1422276-F
  misc_feature (26)..(191): Pfam Name: DUF1264 Pfam Description: Protein of unknown function (DUF1264)
  misc_feature (163)..(163): Xaa is any aa, unknown, or other
MASSDGKPLPTPASVGGGGGSITAPPGQPTTVASEVLDMGAAAMQSLRPVKQAKQHMCTFALYAHYPKRQVETHHYVSRLNQDFLQCAVYDSHKADARLIGVEYIVSRKIFDSLPAEEQRLWHSHAHEIKSGLWTSPHVARLLEKAELDHMAATFGKFWCTWXVDRCDRLTLGAPALMVSPQSYLAAAVRPY

SEQ ID NO: 37121 - DNA, 722 bp, Zea mays
  misc_feature: Ceres CLONE 1422278-F
  misc_feature: Encodes the peptide sequence at SEQ ID NO. 37122
ctccccgcggtggcggccgctctagaactagtggatcccccgggctgcaggaattcgcacgagaccattacctagaacatcctaatcgaaaaaaacgaaaacgagcgggggagctcgcggaccccaaaaccctaaccccgcggacccacctggcggcggcggcggcggcgatggcggacggcggaggagaaggaggacctcctgcggcgtcggcggcgctcaaggaccaggggaatgagcagttcaaggcggggagctacctcaaggctgccgcgctctacacgcaggccatcaagctcgaccccgacaacgccaccctctacagcaaccgagctgcagcattcctgcagttggttaagcttagcaaagcgcttgctgatgcatagacaacagtcaggctgaagccacaatgggagaagggtcatttcaggaaaggttgtgttttggaggcaatggagcgctatgaagaggcgatagctgcatttcagatagctttgcagcacaattcacaaaatacagaagtctcgagaaaaatcaagaggctatctcagttggccagggaaaagaagcgagcccttgatgtagagaacatgcgttcaaatgttgacattgcaaagaacttagaatccctgaagactgagttggctacaaagtatggagatgcagaaacaggcaaaagtagatccaggggtcattttactctccatgatcagaacgacgat

SEQ ID NO: 37122 - protein, 71 aa, Zea mays
  misc_feature: Ceres CLONE 1422278-F
  misc_feature (14)..(47): Pfam Name: TPR_1 Pfam Description: Tetratricopeptide repeat
  misc_feature: SWISSPROT Homolog: EC 3.1.3.16 Phosphoprotein phosphatase
MADGGGEGGPPAASAALKDQGNEQFKAGSYLKAAALYTQAIKLDPDNATLYSNRAAAFLQLVKLSKALADA

SEQ ID NO: 37123 - DNA, 610 bp, Zea mays
  misc_feature: Ceres CLONE 1422279-F
  misc_feature: Encodes the peptide sequence at SEQ ID NO. 37124
aaagctggagctccccgcggtggcggccgctctagaactagtggatcccccgggctgcaggaattcgcacgagaccattacctagaacatcctaatcgaaaaatcatcatcatctctcaaaaacctaatcgtgctctctctctcaaatgggggtcatgacttctactatctccatctcttccaccaagccacagaggcttttcgactcctctttccatggctcatccatatacgccgctactgtctccgttggacagaaaccacgttcggattctgccgtctacgttcacgccagtaccgtcggtaacgatcttaatgccttcacgatcgctcctataaaggaatcgatcgtaactcacgagatgacgaggaggtacatgacagatatgatcacttccactgatacagatgttgtccccaaaggcgctggttcctcctgattatcatgcgcttatgagatcagtaagaacactaacactcacgttgcgatcatcgaacaatctgtaagacacggtggtggcgcgtggctcgctggtaagattgtctccgccatgattgtgcgcacaccagctcacttataccttgactagattggtataacctaaaatga

SEQ ID NO: 37124 - protein, 97 aa, Zea mays
  misc_feature: Ceres CLONE 1422279-F
MGVMTSTISISSTKPQRLFDSSFHGSSIYAATVSVGQKPRSDSAVYVHASTVGNDLNAFTIAPIKESIVTHEMTRRYMTDMITSTDTDVVPKGAGSS

SEQ ID NO: 37125 - DNA, 725 bp, Zea mays
  misc_feature: Ceres CLONE 1422296-F
  misc_feature: Encodes the peptide sequence at SEQ ID NO. 37126
  misc_feature (725)..(725): n is a, c, t, g, unknown, or other
aagctggagctccccgcggtggcggccgctctagaactagtggatcccccgggctgcaggaattcgcacgagaccattacctagaacatcctaatcgaaaaattttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcctttcaagatcaatggagtaccgatccgccgtgtgaaccagacctatgtcattgctacatcaaccaaagttgacatctctggtgttgatgtcgccaagtttgatgacaagtactttgccagggagaagaagcagaaggtgaagaagaccgagggcgagctttttgagacagaaaaggaggtaggtgtctgagtaaaaagatccattattttgtcgacccttgcttcatatctgn

SEQ ID NO: 37126 - protein, 171 aa, Zea mays
  misc_feature: Ceres CLONE 1422296-F
  misc_feature (112)..(170): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGPFKINGVPIRRVNQTYVIATSTKVDISGVDVAKFDDKYFAREKKQKVKKTEGELFETEKEVGV

SEQ ID NO: 37127 - DNA, 694 bp, Zea mays
  misc_feature: Ceres CLONE 1422301-F
  misc_feature: Encodes the peptide sequence at SEQ ID NO. 37128
  misc_feature (574)..(574): n is a, c, t, g, unknown, or other
  misc_feature (580)..(580): n is a, c, t, g, unknown, or other
  misc_feature (589)..(589): n is a, c, t, g, unknown, or other
ctggagctccccgcggtggcggccgctctagaactagtggatcccccgggctgcaggaattcgcacgagaccattacctagaacatcctaatcgaaaagagctgagaccgccgagaggcacacagcacaggcaccaccgcaccagcccttgccgcgtataaaacgtctcgtgcgtaggcggcgccgcggcgactaggctgtccccgtggcactatattgggggttgcattatcaggcatccgaccgacggcatgaggaggaaagggagcgactgtacacggatcagcccagccgagatcacgcccatgatctccctgccgtccaggcggtccgcgggccggacggcgtcggcgccggaccgggaccgggaggaggagcgacctcggcaacggcgagtgcgaggcgcgtgcggctctcgcctgctgcggaccgcgcggtggacggccgcgcgcttctacaggcgagcgcgggtaagcatcgcccaggcgtttcggcccccgtcgacgacggcggccaagagagcacaagcaggcgccggcgccgctttcgccgactgcggcacgcgggcgaagcngcgtantagcaggcngcagcagcagtcgtcccgcgcgacgacggtcgtcgtcctcgatgactcgcacaaaaacgagcggtggaagagtgcatcagggtcataaactcctcgtcaggaaat

SEQ ID NO: 37128 - protein, 141 aa, Zea mays
  misc_feature: Ceres CLONE 1422301-F
  misc_feature (108)..(108): Xaa is any aa, unknown, or other
  misc_feature (110)..(110): Xaa is any aa, unknown, or other
  misc_feature (113)..(113): Xaa is any aa, unknown, or other
MRRKGSDCTRISPAEITPMISLPSRRSAGRTASAPDRDREEERPRQRRVRGACGSRLLRTARWTAARFYRRARVSIAQAFRPPSTTAAKRAQAGAGAAFADCGTRAKXRXSRXQQQSSRATTVVVLDDSHKNERWKSASGS

SEQ ID NO: 37129 - DNA, 722 bp, Zea mays
  misc_feature: Ceres CLONE 1422302-F
  misc_feature: Encodes the peptide sequence at SEQ ID NO. 37130
  misc_feature (536)..(536): n is a, c, t, g, unknown, or other
  misc_feature (537)..(537): n is a, c, t, g, unknown, or other
aagctggagctccccgcggtggcggccgctctagaactagtggatcccccgggctgcaggaattcgcacgagaccattacctagaacatcctaatcgaaaaatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaatgcatattgtgtcaggggtggtccagaannagagctaaagcatacagtacttggagagaagagagtgtgagtacgaccagaaaatatcattgatttctacaagaaggagatcccttgaaacagctgtgacgggcgtcttagtgttcgtttccactcagatccatttgcaacaatactatcttggccctgctcctctgcaggatatggcaggcaaa

SEQ ID NO: 37130 - protein, 76 aa, Zea mays
  misc_feature: Ceres CLONE 1422302-F
  misc_feature (3)..(75): Pfam Name: ChaC Pfam Description: ChaC-like protein
  misc_feature (74)..(74): Xaa is any aa, unknown, or other
  misc_feature (75)..(75): Xaa is any aa, unknown, or other
MVLWVFGYGSLIWNPGFDFDDKILGFIKGYKRTFNLACIDHRGTPEHPARTCTLETDDEAICWGMHIVSGVVQXXS

SEQ ID NO: 37131 - DNA, 716 bp, Zea mays
  misc_feature: Ceres CLONE 1422310-F
  misc_feature: Translation starting site: 216
  misc_feature (530)..(530): n is a, c, t, g, unknown, or other
  misc_feature (639)..(639): n is a, c, t, g, unknown, or other
  misc_feature (676)..(676): n is a, c, t, g, unknown, or other
ctccccgcggtggcggccgctctagaactagtggatcccccgggctgcaggaattcgcacgagaccattacctagaacatcctaatcgaaaattacctcacgctctctcgtggtcgttgcttcctggcggcggcgccgccctcttcgtcgggccattcaccggcgacgagcattcatctggaggagagcatcacactcatctaactgatattaggatgagtctatgtacaatagcacgccgactatgtctttcaaaaccatcctctgtgaatcgtctttcagtaatttgggctcatctatacagcaccgaggctgcaaaggacacgggtgctaagaagtacaagtaccctgatgtatacgacccatacgggcctatgtcgctaccgtcagagaaagttgtggatctagctgaccgcatcgctgctctccctcctgaggagatcaaacagattgctccagcccttctattcagactgaaccaagagccgccacaggctatctccggccagggtttcagttttggtgctcanggtggtgcgggggtcggtgccggaaaggctgaggaaaagaagctgagaagacagtcttcgatgtcaagtggaagaaaatcgatgctgctgcaaaagatcagattatcanggagatcaggacctttacggatttggggctgaaggangcaaaagagctagtgaaagaagccccagtcattctgaaga

SEQ ID NO: 37132 - DNA, 650 bp, Zea mays
  misc_feature: Ceres CLONE 1422329-F
  misc_feature: Encodes the peptide sequence at SEQ ID NO. 37133
aaagctggagctccccgcggtggcggccgctctagaactagtggatcccccgggctgcaggaattcgcacgagaccattacctagaacatcctaatcgaaaaagtaagtaagaacagatgtcaaacaacacttcccatgttcctcccatgcccctctctcatcacttcagcgactatggcttcgatccccagatcgactactttcaggttttggaagaagcgaggaagcacaagaaagaaactccctccattgacagtatacatcagttcaagctccagaaacctatatctaaggatgatctgatccgaaccgctctccacaagaagaagaagcgctggttcttgaaaaacgctatgctcttcttcagctggcggaaatggcgaaggcgaggcagtcattacgcagaggaaggagacgtggagatggaactcgacgttcacatggcgagggctaggaaacttcgcgccacatcagtcgtcggagccggttcgatatctggtccggtttacgtgacggagagctggagcgggtcgagcacaccgtaccgaacgataagaccttcttcgctgacgtcgacgccagctgctgtttcgtatatgagtctacgggagcttaacatggaggcgcaacagaggagcaacgcatcttc

SEQ ID NO: 37133 - protein, 167 aa, Zea mays
  misc_feature: Ceres CLONE 1422329-F
MPLSHHFSDYGFDPQIDYFQVLEEARKHKKETPSIDSIHQFKLQKPISKDDLIRTALHKKKKRWFLKNAMLFFSWRKWRRRGSHYAEEGDVEMELDVHMARARKLRATSVVGAGSISGPVYVTESWSGSSTPYRTIRPSSLTSTPAAVSYMSLRELNMEAQQRSNAS

SEQ ID NO: 37134 - DNA, 651 bp, Zea mays
  misc_feature: Ceres CLONE 1422340-F
  misc_feature: Encodes the peptide sequence at SEQ ID NO. 37135
aaagctggagctccccgcggtggcggccgctctagaactagtggatcccccgggctgcaggaattcgcacgagaccattacctagaacatcctaatcgaaaaataggaatcatccatcgcgtctgtgctccccctcgcgcaatcctaccgcactcgcctcccgaaatcggccgccacggcgcctcacgccatggctcctgcccagcagctgcagctccctccgcctccggtggtctggcacgccgcctcctcgcccagatccgtccgtggtccgcccctccggcctcgcccagctccaaagctccctcctgctcgcgggcacgcgatctcgccctgggggccatgccctaggccgtcgtctcggctcgcgtccacctcgtccagcgtcacaagtggcgccgccgccggtgtcggctacttcgatctcccgcccgccgtcgactcgtccagcagtacctacgctctgaatccgatcccctcgccggtggcgacggcgtcggctgacccatccccaaactcggcgcgggagcccaagcggaagcgaactggcccgtgcgtcccccgcatcaactcgaaccgaagggacgaccaagcggagtctagactcaagagcaaccgcgacctcccggatctctctcccacccacgcctc

SEQ ID NO: 37135 - protein, 153 aa, Zea mays
  misc_feature: Ceres CLONE 1422340-F
MAPAQQLQLPPPPVVWHAASSPRSVRGPPLRPRPAPKLPPARGHAISPWGPCPRPSSRLASTSSSVTSGAAAGVGYFDLPPAVDSSSSTYALNPIPSPVATASADPSPNSAREPKRKRTGPCVPRINSNRRDDQAESRLKSNRDLPDLSPTHA

SEQ ID NO: 37136 - DNA, 656 bp, Zea mays
  misc_feature: Ceres CLONE 1422344-F
  misc_feature: Encodes the peptide sequence at SEQ ID NO. 37137
ctccccgcggtggcggccgctctagaactagtggatcccccgggctgcaggaattcgcacgagaccattacctagaacatcctaatcgaaaaaacaagacagagagatacccgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgggatctccgccatcgtcggcggcgcgctctccggctgggccttcggcggccgccgcgctccccggggccccctgggatgtaccgcttcctccagggggcccccacccccggggggcccaacccgggtggaccaccccccccaagcgggattccccaaacccccccggcccctttaagggaatacccccgccggattcagggggaaaaccttgccccccccccccccaaggaaccccccgccccgggggggg

SEQ ID NO: 37137 - protein, 138 aa, Zea mays
  misc_feature: Ceres CLONE 1422344-F
MGDRHQHGPGSGVEDPATLLRRVQTRAPNSTQVVGFLTLLVSGAVLLLLTGVTLTGAVVALVFLGPIALLTSPIWVPVAVGISAIVGGALSGWAFGGRRAPRGPLGCTASSRGPPPPGGPTRVDHPPQAGFPKPPRPL

SEQ ID NO: 37138 - DNA, 752 bp, Zea mays
  misc_feature: Ceres CLONE 1422353-F
  misc_feature: Encodes the peptide sequence at SEQ ID NO. 37139
  misc_feature (6)..(6): n is a, c, t, g, unknown, or other
tttttntttcccccccccccctcccacagcgtgggacaacaattctcatctcacactctcatcacagtggcccccctaaccccatcaaactggtgctccccgcggtggcggccgctctttactagtggatcccccgggctgcaggaattcgcacgagaccattacctagaacatcctaatcgaaaaaaaaataattcagcgacagatatcttcgactccgcggtcgtggttccccatcgtcgtcgccatggatttctcttaggatcacccgtccgcgcggatcgattcgttccccactctcgctgatcccgtcgcacttccctcctcgctgcagcccctctactattgcgattaccgtttcctcgctgccctttcctttttcggtcggcagcaatcaccggggcaagcgaaccctcgatttgcgtccccggtctctgctagcgcccctaaaagaggagcgaagcgatgtctatgtcgaagacgggtcaggccgcggagaaggatgagcagcggcggtcccgagggatagcactgatgcaggggatctgcgccgtggcgtacctcaaggccgataagacgtccctgccccaggcaagcaagggtctctaccttggggatctgttgggagccaggatttcaattaaggggcgcctctccaagaagtttggaaccatgcccccaatcatccttggaatctgtttgcaacaggtcccctgggaattccaagaaatttcccccgacctggaaatatt

SEQ ID NO: 37139 - protein, 95 aa, Zea mays
  misc_feature: Ceres CLONE 1422353-F
MSMSKTGQAAEKDEQRRSRGIALMQGICAVAYLKADKTSLPQASKGLYLGDLLGARISIKGRLSKKFGTMPPIILGICLQQVPWEFQEISPDLEI

SEQ ID NO: 37140 - DNA, 752 bp, Zea mays
  misc_feature: Ceres CLONE 1422354-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (39)..(39): n is a, c, t, g, unknown, or other
  misc_feature (50)..(50): n is a, c, t, g, unknown, or other
  misc_feature (82)..(82): n is a, c, t, g, unknown, or other
nnnnnnnnnnnnnggggnncccggcggcnnanccgccanaaggagagcanaccaaagcggagctcaccgcggtggggggggntgtgtttctaaaaaacccccgggctgcaggaattccaccagaccattacctagaacatcctaatagaaaaagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcaacgctagctagctcgccggaacggcaggtggcggcgcgcgacctgagagcacagcagcaccggaccggctcaagcaggcgaccggcagaaaagatggcgggagcagcaggtgtggaggcggcagcggctgcggcggtggcggccaaccgaaaggcgtgctgccacgccgccaaggggcccgggtactccaccccgctggaggccatggacaagggccccaggggagaagctcggcgacgtgcccctgccgtctacgacgggcaccggaaataaacaaagccggattacacttgacgacggtagcattttcgattccccagcttctcactacagtactccccggggtggagtccactagggcttcccggggtctacccagccctcccggcgaatggagggcgggcactcagcgcccttgggcgtggggaag

SEQ ID NO: 37141 - DNA, 655 bp, Zea mays
  misc_feature: Ceres CLONE 1422358-F
  misc_feature: Translation starting site: 216
  misc_feature (464)..(464): n is a, c, t, g, unknown, or other
  misc_feature (465)..(465): n is a, c, t, g, unknown, or other
aagctggagctccccgcggtggcggccgctctagaactagtggatcccccgggctgcaggaattcgcacgagaccattacctagaacatcctaatcgaaaaaaaagcagcagcaacagccaacacctaaactaaagaacagtagtagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagtcacggcgggcagacccggagtgagcagctgggccatgaggggtacagcgagatgggcagcaagggcgggcagacccgcaaagagcagctgggccacgaagggaccagcgagatgggggagaannggcggcctgagcaccatgcaagagtccggccgcgagcgcgccgcccgggaaggcatcgagatcgacgagtcccaggtcaggaccaagtcctagatctgatgcgtgccccccgcttagcatgtaatacgtagctgcaagaattgattgtcgtcgtaatagtaagggagtcgtaaaaactgccgctccttct

SEQ ID NO: 37142 - DNA, 671 bp, Zea mays
  misc_feature: Ceres CLONE 1422361-F
  misc_feature: Encodes the peptide sequence at SEQ ID NO. 37143
atagctggagctccccgcggtggcggccgctctagaactagtggatcccccgggctgcaggaattcgcacgagaccattacctagaacatcctaatcgaaaacttgccctctcctacttctcctcccccgccccgccgccattccccccccactcttcaccaccgccattcccccccccactcttcaccaccgcagcgccgccgcgtacaaggcgattaggcgaagctgcaccggaaggagaaggagagaagcgagagtctccccagccagagcaagccgaatccgaagctagcggagaggagagagggctgagtgaggatgccgacggttacctgcaacgcgtgcaacgcggggttcgacgacgaggagcagcagcggcttcactaccgctctgaatggcaccgttacaacctcaagcgcaaggtggctggagttcctggtgtcacagaggctctgtttctggctaggcaagctgctttggcggaggggagcaagcctgctagcaccccaatgctttacaggtgtgctctttgtgggaaggagtacagaagctcgaaagctcacgagcagcatcttaactcgcgatcacatcttttgaaagcctctcaggagccccatgcctctattgctggtatcacgaatatcaagccacttcctgaacgagtctcag

SEQ ID NO: 37143 - protein, 117 aa, Zea mays
  misc_feature: Ceres CLONE 1422361-F
  misc_feature: The sequence is a functional homolog of SEQ ID NO 512 in the 11/479,226 US patent application
  misc_feature: The sequence is a functional homolog of SEQ ID NO 1304 in the 11/479,226 US patent application
  misc_feature: The sequence is a functional homolog of SEQ ID NO 610 in the 10/412,699 US patent application
MPTVTCNACNAGFDDEEQQRLHYRSEWHRYNLKRKVAGVPGVTEALFLARQAALAEGSKPASTPMLYRCALCGKEYRSSKAHEQHLNSRSHLLKASQEPHASIAGITNIKPLPERVS

SEQ ID NO: 37144 - DNA, 819 bp, Zea mays
  misc_feature: Ceres CLONE 1422363-F
  misc_feature: Encodes the peptide sequence at SEQ ID NO. 37145
  misc_feature (819)..(819): n is a, c, t, g, unknown, or other
tttttttttttgcgcccgcccggccgccattaccccttttatttgcccccggtttcttccgtctgccgcccccccctttattcaaagctggagctccccgcggtggcggccgctctatactagtggatcccccgggctgcaggaattcgcacgagaccattacctagaacatcctaatcgaaaaacccacaccaaccctctgtgcctcggtccctccgcccgtacgcgcgacgagagacacgatgcggcggtccctaccccttctcctcgcgcggcaggtggcgcggcggcggcggctgagcaacgtgccggagtccaccgtctacgggggcccacgcccgcaggagtcctcggcggcgcggcgcgtgacggtgaccacactccgtgggaagcaccgccgcggggagcccatcaccgtcgtcaccgcctacgactacccctcgggcggtccacgttccactccgccgggcatcgacgtcctgccctcttcggggaactccgcccgccattggttcgtccacgggccaacgaacacccacgctcccccatcacgcctccgaaaatcatgcctttgaagcacttgccccgcgcccgtgggacccgggggggcggcgcacgctgccccgtcttcctccgtgagggggaatcctcccccattccgggctggctacaaaagttcccctccacccggcccaagggcctgttttgaatttccacgccgtgggagggggtccctctccagggaaggggggggaaaagtggatttgcccaatcaacaccttgggaaaagggggtggtgtcccccccctccggagggan

SEQ ID NO: 37145 - protein, 110 aa, Zea mays
  misc_feature: Ceres CLONE 1422363-F
  misc_feature: SWISSPROT Homolog: EC 2.1.2.11 3-methyl-2-oxobutanoate hydroxymethyltransferase
MRRSLPLLLARQVARRRRLSNVPESTVYGGPRPQESSAARRVTVTTLRGKHRRGEPITVVTAYDYPSGGPRSTPPGIDVLPSSGNSARHWFVHGPTNTHAPPSRLRKSCL

SEQ ID NO: 37146 - DNA, 842 bp, Zea mays
  misc_feature: Ceres CLONE 1422370-F
  misc_feature: Encodes the peptide sequence at SEQ ID NO. 37147
  misc_feature (1)..(1): n is a, c, t, g, unknown, or other
  misc_feature (22)..(22): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (468)..(468): n is a, c, t, g, unknown, or other
  misc_feature (501)..(501): n is a, c, t, g, unknown, or other
  misc_feature (622)..(622): n is a, c, t, g, unknown, or other
  misc_feature (623)..(623): n is a, c, t, g, unknown, or other
  misc_feature (630)..(630): n is a, c, t, g, unknown, or other
  misc_feature (728)..(728): n is a, c, t, g, unknown, or other
nccccccccccccccccccccncccacccccccccgggnnnttcaaactggggctccccgcggtggcggccgctctagactagtggatcccccgggctgcaggaattcgcacgagaccattacctagaacatcctaatcgaaaaatctccttgcccgttgtgctctctctcttcattcgttgtcggtctcaccccgagccagccgtctcggtagggtttagccggcgccgccgtcatgcctcgccgcagctcaggaaggtctggcccacgcccagctccgcgtgctgcttcgatgaggaacccgccacagtcaggagggcaggttcctcctccagctcctgttcgagatggtggtggctccatgtatggaggaattgggtcctcctttgactcaaagtatggcgtttggcgggggtaggggcagggcacacaggggtggttgattcttttttttgggtcccccggagngggtcagggaggtagagtcttgggccccacaanctccttgggtatttggccccgtgctttctccaacgtatggatagggccgggagggtttagacgggttgtctttttcgtggggtggttttccctcccttgccctggcggccaacctcctganngaagttnagtacctaccgattgttattgggtgtgactctgaagagtgggtcgcaaagaggtgtgtcgtctcgtaagaacggtgttttcttggcctggagaagctnccacccgtggtggctgctctctatgggggtttatttttcttcttcttgcgtcccggccccgcctatttaagcccaagacccaggacgagatactgtcctcccccgccccctcgg

SEQ ID NO: 37147 - protein, 31 aa, Zea mays
  misc_feature: Ceres CLONE 1422370-F
MVVAPCMEELGPPLTQSMAFGGGRGRAHRGG

SEQ ID NO: 37148 - DNA, 652 bp, Zea mays
  misc_feature: Ceres CLONE 1422373-F
  misc_feature: Encodes the peptide sequence at SEQ ID NO. 37149
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaaagtagtaaaaccaggtaggtgtggctggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactggtcctgtagttctttgtggaaccaaactagatctccgtgaagacagatcttaccttgctgacccatctgctgcttccatcatctctactgaacagggagaagagctcangaagcagataggcgctgtggcgtacatagaatgca

SEQ ID NO: 37149 - protein, 165 aa, Zea mays
  misc_feature: Ceres CLONE 1422373-F
  misc_feature (15)..(165): Pfam Name: Ras Pfam Description: Ras family
  misc_feature (15)..(128): Pfam Name: Miro Pfam Description: Miro-like protein
  misc_feature (154)..(154): Xaa is any aa, unknown, or other
MSAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTGPVVLCGTKLDLREDRSYLADPSAASIISTEQGEELXKQIGAVAYIEC

SEQ ID NO: 37150 - DNA, 723 bp, Zea mays
  misc_feature: Ceres CLONE 1422390-F
  misc_feature: Encodes the peptide sequence at SEQ ID NO. 37151
  misc_feature (723)..(723): n is a, c, t, g, unknown, or other
aagctggagctccccgcggtggcggccgctctagaactagtggatcccccgggctgcaggaattcgcacgagaccattacctagaacatcctaatcgaaaaacgaatattctctctagatgccgcatcatcccgtccgcgaacgtcgccgtccgggacggagcgcctcgctcgcaacccacccctcctctctcggcgactcggttctccctcccgcgggacgccaccggagctgactgccgctgctggggcctggccgttctctcatggtcatggagacgccttcgcaggagatggacccagagcaacatggggacaacatggcaggcaagggtggagctggacaggtctattggtccaacgcaatgtctagttttgtgctcaaatatttggccgacctagttgcgagtggaactaaaatcacgagcggcttcaagcaagctcatcttaacagctgtgctagagctttgtatgagaagctaggtgtccagcgcaccggcggacaagtcggcaaccatctcaggaagtggaaaaggatttatgcgaagatcgagaagctgaagaacctggatggagctgtctgggatgaacataattgcgtaatcagtcttgacgcagagcattacaataaccatattaaggaccaccgtgaggatgccaactacttgaacattccggtcgagcattatcatgagatggccattatatctggcaacagttcggn

SEQ ID NO: 37151 - protein, 152 aa, Zea mays
  misc_feature: Ceres CLONE 1422390-F
MVMETPSQEMDPEQHGDNMAGKGGAGQVYWSNAMSSFVLKYLADLVASGTKITSGFKQAHLNSCARALYEKLGVQRTGGQVGNHLRKWKRIYAKIEKLKNLDGAVWDEHNCVISLDAEHYNNHIKDHREDANYLNIPVEHYHEMAIISGNSS

SEQ ID NO: 37152 - DNA, 624 bp, Zea mays
  misc_feature: Ceres CLONE 1422399-F
  misc_feature: Encodes the peptide sequence at SEQ ID NO. 37153
aagctggagctccccgcggtggcggccgctctagaactagtggatcccccgggctgcaggaattcgcacgagaccattacctagaacatcctaatcgaaaaacctagaacatcctaatcaaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcagcgttggcagcaccccgatcctggcccagtgcgtcgagtttctgaggcatcagtgcagcccgacggcgacgccctact

SEQ ID NO: 37153 - protein, 43 aa, Zea mays
  misc_feature: Ceres CLONE 1422399-F
MPVPTAASKPVPAAGNLQRWQHPDPGPVRRVSEASVQPDGDAL

SEQ ID NO: 37154 - DNA, 646 bp, Zea mays
  misc_feature: Ceres CLONE 1422400-F
atagctggagctccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaatgcgccccgcaggcccacctttcgtgggcatctggaaaaaaaccgtgcgggggaagca

SEQ ID NO: 37155 - DNA, 647 bp, Zea mays
  misc_feature: Ceres CLONE 1422409-F
  misc_feature: Encodes the peptide sequence at SEQ ID NO. 37156
aagctggagctccccgcggtggcggccgctctagaactagtggatcccccgggctgcaggaattcgcacgagaccattacctagaacatcctaatcgaaaagaagtctatctttttctcctcctgccgtacgtccgttccagcttgcaaagcgctcgcgagctgctgccatggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccggcgcctctgggccgccgccgaagccgaagctggctaccgcgtgctcacccgaagccggacctcttcatggggccgccgaagaacggcttcgtcggcggcggcattggttacatccgcgcccaagaagttgaccaagaccaccttccccgcaagggggggcggcgcccttccccttaacgttcccggggcccgggggaaccctgggtcacccggcctcaaaggaacaaggg

SEQ ID NO: 37156 - protein, 159 aa, Zea mays
  misc_feature: Ceres CLONE 1422409-F
  misc_feature: SWISSPROT Homolog: EC 1.5.3.1 Sarcosine oxidase
MAGAGAPAVPQAGRPAPNFDVIVVGAGIMGSCTAHAAASRGARVLLLERFDLLHPLGSSHGDSRIIRDAYAQPRYLRMVRLARRLWAAAEAEAGYRVLTRSRTSSWGRRRTASSAAALVTSAPKKLTKTTFPARGGGALPLNVPGARGNPGSPGLKGTR

SEQ ID NO: 37157 - DNA, 671 bp, Zea mays
  misc_feature: Ceres CLONE 1422432-F
  misc_feature: Encodes the peptide sequence at SEQ ID NO. 37158
ggcggccgctctagaactagtggatcccccgggctgcaggaattcgcacgagaccattacctagaacatcctaatcgaaaatttcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgataatctgaatgtgtggaggacccttttcttctagattttatcttcagctgtccttgtaagggttgtgttcaggttgagagttagcaggttgagctgtctatctgagaaccatttaaagttctctgagttttggtgttatggatcactggaagtattatatgaagtttaagttagaactaatttgtttgccata

SEQ ID NO: 37158 - protein, 101 aa, Zea mays; identical to SEQ ID NO: 37086
  misc_feature: Ceres CLONE 1422432-F
  misc_feature (12)..(101): Pfam Name: Ribosomal_L35Ae Pfam Description: Ribosomal protein L35Ae

SEQ ID NO: 37159 - DNA, 670 bp, Zea mays
  misc_feature: Ceres CLONE 1422434-F
  misc_feature: Encodes the peptide sequence at SEQ ID NO. 37160
aagctggagctccccgcggtggcggccgctctagaactagtggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatggggatgaatgcaactgctggactctcatctggcatggcaccatctcctggctttgcttctgccccaaaagagaaaggcttttctgggatttatgatccgactttatgaatggggggaggttcccggtggctgtctcccagaacaacttccacctcccaattgaactgggcaaagccttttgattcagaaacccggaataaaattgttcagaaatgggaaggcttttctgaaacctatcaagggttattgggggaccggc

SEQ ID NO: 37160 - protein, 81 aa, Zea mays
  misc_feature: Ceres CLONE 1422434-F
MADELRSTSVGQKFHGQSVLLSRISSYSAMNNPVFNNAYSAYNVPQRSYHGDECNCWTLIWHGTISWLCFCPKRERLFWDL

SEQ ID NO: 37161 - DNA, 714 bp, Zea mays
  misc_feature: Ceres CLONE 1422436-F
  misc_feature: Encodes the peptide sequence at SEQ ID NO. 37162
aagctggagctccccgcggtggcggccgctctagaactagtggatcccccgggctgcaggaattcgcacgagaccattacctagaacatcctaatcgaaaaagccttccccgtctctcctcttctgccgaacgagacagaccgggttatgtagcctgcctcgctttcggcgagagaggaagaggcggaggagatcagggcaatgggcggggcggaggcgctgggccagccggacggccatgcgaacggggccgtggtggaggagaagctggacttgctgcggcggcagctggggaaggcggacggcgacccgctccggatcgtcggcgtcggggcgggcgcctggggtagcgtcttctgcgcgctgctgcaggacgcgtacggccacctccgcgacaaggcgcaggtccgcatctggcgccgcccgggccgagccgtcgaccgcgccaccgccgagcacctcttcgacgtcatcaacgcgcgcgaggacgtcctgcgccgcctgatccgccgctgcgcctacctcaagtacgtcgaggcgcgcctcggcgaccgcacgctctacgccgacgagatactcagggacggcttctgccctcacatgatcgacacgccgctcctgcccgctcaaggtcgtcaccaaccctgcaggaggccggtctggggacgcttgactttgtccgccaacgggcctgccttcccaccgaaacccagg

SEQ ID NO: 37162 - protein, 171 aa, Zea mays
  misc_feature: Ceres CLONE 1422436-F
MGGAEALGQPDGHANGAVVEEKLDLLRRQLGKADGDPLRIVGVGAGAWGSVFCALLQDAYGHLRDKAQVRIWRRPGRAVDRATAEHLFDVINAREDVLRRLIRRCAYLKYVEARLGDRTLYADEILRDGFCPHMIDTPLLPAQGRHQPCRRPVWGRLTLSANGPAFPPKPR

SEQ ID NO: 37163 - DNA, 689 bp, Zea mays
  misc_feature: Ceres CLONE 1422441-F
  misc_feature: Translation starting site: 378
  misc_feature: Pfam Name: ESCRT-II Pfam Description: ESCRT-II complex subunit
  misc_feature (124)..(124): n is a, c, t, g, unknown, or other
  misc_feature (385)..(385): n is a, c, t, g, unknown, or other
  misc_feature (458)..(458): n is a, c, t, g, unknown, or other
  misc_feature (488)..(488): n is a, c, t, g, unknown, or other
  misc_feature (499)..(499): n is a, c, t, g, unknown, or other
  misc_feature (542)..(542): n is a, c, t, g, unknown, or other
  misc_feature (558)..(558): n is a, c, t, g, unknown, or other
aagctggagctccccgcggtggcggccgctctagaactagtggatcccccgggctgcaggaattcgcacgagaccattacctagaacatcctaatcgaaaaattgtagcatgtgttagtcattngccttcctcttgtcgtcatctgctggtgcaggagcgccgagcgcagatccatcaggattggagtgttttcctcgtcttcaagcgagaagggtcttcaggacttgttttttgggcgggcgcagttgcggagatgcagaggctgggggatttcaggctccctcccttcttcaactaccctccttacttcacctatatgtggaagagatggtccatgatgctgaattggttatggatgtaatctaatttgcagcctatgcgtgnaacacgggaaaagcaagtacagttatggaaaaatatgatactcgattactgtagaagtcaaaagatacatacnatatcccctggaagaagattttccccatgntctcccatccnaagattgagagatctcttaccctatgagcaaaagaagtgtccnttgcagctctcgtcantgaaggtcgtgctgagtggatggacaaaggtcacaagaagtgcctaagttcttgggctaaagaaaccgggattgggcccaatttcaaattaaactttgtaaagggaaaaaggggtttgaaagtaatgccaa

SEQ ID NO: 37164 - DNA, 752 bp, Zea mays
  misc_feature: Ceres CLONE 1422448-F
  misc_feature: Encodes the peptide sequence at SEQ ID NO. 37165
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (19)..(19): n is a, c, t, g, unknown, or other
  misc_feature (33)..(33): n is a, c, t, g, unknown, or other
  misc_feature (34)..(34): n is a, c, t, g, unknown, or other
  misc_feature (44)..(44): n is a, c, t, g, unknown, or other
  misc_feature (52)..(52): n is a, c, t, g, unknown, or other
ttgggnnngggggggggtnatagggggtttttnntttttttttnacccccancccccatgagtggagctccccgcggtggcggccgctctagaactagtggatcccccgggctgcaggaattcgcacgagaccattacctagaacatcctaatcgaaaagtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgcctcgagcacgaccttggcgacggcaagggcttcgtctcagctggaaccttcgtcggcccgcctcaagaccttcgcccacggcacgcagacccttcactaaactttcgcttgtagagggaattatttttactggaggatgataaacgcggcggttcaacaaaaagggcttccaggaaagatgggctttttatcctatctagggctgggcgtcctaatgggggttgggtacgcctcccgcggaagagcgttccggggcttgggtgtgctttcaagctgggaactttggggaggg

SEQ ID NO: 37165 - protein, 126 aa, Zea mays
  misc_feature: Ceres CLONE 1422448-F
MAPPRRALLVLAALLLSLSLGAASFHSDELLLNDDEEFEGVVARPSAPSPPAAPVVSSSRRRSADAPLPGSGESNAVQFTPRARPWRRQGLRLSWNLRRPASRPSPTARRPFTKLSLVEGIIFTGG

SEQ ID NO: 37166 - DNA, 842 bp, Zea mays
  misc_feature: Ceres CLONE 1422449-F
  misc_feature: Encodes the peptide sequence at SEQ ID NO. 37167
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (796)..(796): n is a, c, t, g, unknown, or other
nnnnnnnnnnnnnnnnnnnnngggtgattggggnnnntccccnnnnntcaaaactgggactccccgcggtggcggccgctctagaactagtggatcccccgggctgcaggaattcgcacgagaccattacctagaacatcctaatcgaaaaatgtcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggtaaaacctcccccgcgctccgggcatgcgccggcggccgcagccgcttgccatcgagcaggcatgggtcacgatcgaccgttcctgtgtggtctgcgtgcggcgtttcgccaggcgacggtagggggatgaaccgtcaagggaaggagtggcctcgcgctgggttgcatgccccacccaactggcaagaaggggggcaccagcctctccctggggtgggttccggcatgcctacccagccgggcccccccccgcgccgggctggggtgcggaacaaagagcggggtaaggccccccgggggaaagtggcgtccccaccggagcctctgctggacgtgccgctagaccggggccgaccgacccggccccgcttcgcgccggtcctgtccgaaattctcgaatcttcggtaaaccggttgcaacaacgtagccatggagcaaagcaagaactcttctcttccttctaccctgagtatactctgtccggcntatccaacacattacacggccactatatctcttgtcacccacaagc

SEQ ID NO: 37167 - protein, 50 aa, Zea mays
  misc_feature: Ceres CLONE 1422449-F
MAMAYKMVKPPPRSGHAPAAAAACHRAGMGHDRPFLCGLRAAFRQATVGG

SEQ ID NO: 37168 - DNA, 675 bp, Zea mays
  misc_feature: Ceres CLONE 1422450-F
  misc_feature: Encodes the peptide sequence at SEQ ID NO. 37169
  misc_feature (595)..(595): n is a, c, t, g, unknown, or other
  misc_feature (644)..(644): n is a, c, t, g, unknown, or other
  misc_feature (670)..(670): n is a, c, t, g, unknown, or other
ctggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaatgaaaggagctgtncagaaagcggaagagatacaagcaaagacacccaactcttacatccttncacaatttgaaaatccagctaacccnaagat

SEQ ID NO: 37169 - protein, 158 aa, Zea mays
  misc_feature: Ceres CLONE 1422450-F
  misc_feature (12)..(158): Pfam Name: PALP Pfam Description: Pyridoxal-phosphate dependent enzyme
  misc_feature: SWISSPROT Homolog: EC 2.5.1.47 Cysteine synthase
  misc_feature (149)..(149): Xaa is any aa, unknown, or other
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVQKAEEIQAKTPNSYILXQFENPANPK

SEQ ID NO: 37170 - DNA, 690 bp, Zea mays
  misc_feature: Ceres CLONE 1422452-F
  misc_feature: Encodes the peptide sequence at SEQ ID NO. 37171
atagctggagctccccgcggtggcggccgctctagaactagtggatcccccgggctgcaggaattcgcaagagaccattacctagaacatcctaatcgaaaattcactctctggcttcccgatctcttctctctctctctcgtctctcacatctccagcccttcgccctcttctcggcccgacctcgacggtgttccaccatctcctaccctcttcttttcccgcccgcgccatccctttctccgctgtagccactgcaagccccgcgcgacgcacacggcagtggtccacgtcgaccaaatcgtccacagcatcgcgttctcctcggcgagggtctgtagcctgccggcgaggagctcgcagcgaagatccgtgcaagccaccctccagatcgtcacagctatgaatgactgcgacaaccaccattttcgccacaattcagcggatgcattgggttgttgggcattgatgattctatgcaggctatgcagcatgtagcagccagacaacaaccatgagtctcgcttgtcttgtatgccatggcatgagcagcccctcgcactctcttagaagctactcggtgtcaagctcagaggaggaaagccggtgtggagctgttgttgcctgcttagctcgaagagtaacaccagctggaacctctactagcgttgggacatcgaaagtgacccc

SEQ ID NO: 37171 - protein, 58 aa, Zea mays
  misc_feature: Ceres CLONE 1422452-F
MSLACLVCHGMSSPSHSLRSYSVSSSEEESRCGAVVACLARRVTPAGTSTSVGTSKVT

SEQ ID NO: 37172 - DNA, 710 bp, Zea mays
  misc_feature: Ceres CLONE 1422453-F
  misc_feature: Encodes the peptide sequence at SEQ ID NO. 37173
  misc_feature (110)..(110): n is a, c, t, g, unknown, or other
  misc_feature (131)..(131): n is a, c, t, g, unknown, or other
  misc_feature (140)..(140): n is a, c, t, g, unknown, or other
  misc_feature (162)..(162): n is a, c, t, g, unknown, or other
  misc_feature (173)..(173): n is a, c, t, g, unknown, or other
  misc_feature (670)..(670): n is a, c, t, g, unknown, or other
tggagctccccgcggtggcggccgctctagaactagtggatcccccgggctgcaggaattcgcacgagaccattacctagaacatcctaatcgaaaaatatatgtaactntcattcttgcaacatcacaangcacacagngctttcacacccatcttgcatntggctctccgngctgctgttcttgcttcctcgctgcacacaaccaagcaaagtcacttttccaaggtaaagaagcatgcatccgagctgctctccactggcagtgcctccgggcttccggttccacccgacagacgaggagctcctctactactacctgaggaagaaggttgcctatgagcccatagatcttgatgtcataagggaggtggacctcaacaagcttgaaccatgggacctcaaagatcggtgcaggattgggacggcggagcctcaggacgagtggtatttcttcagccacaaggacaggaagtaccctacggggacgcgaaccaaccgggcgacgacggctgggttctggaaggcgaccggacgggacaaggccatcttcctcggcaacgctgggaggaggatcggcctgaggaagacgctggtgttttacactggcagggcaccccatggcaagaagacggactggatcatgcacgagtaccgcctcaacgatgacnacgtcgaagtgccgccgaatacggtaagcacgcagcgcac

SEQ ID NO: 37173 - protein, 157 aa, Zea mays
  misc_feature: Ceres CLONE 1422453-F
  misc_feature (10)..(142): Pfam Name: NAM Pfam Description: No apical meristem (NAM) protein
  misc_feature (145)..(145): Xaa is any aa, unknown, or other
MHPSCSPLAVPPGFRFHPTDEELLYYYLRKKVAYEPIDLDVIREVDLNKLEPWDLKDRCRIGTAEPQDEWYFFSHKDRKYPTGTRTNRATTAGFWKATGRDKAIFLGNAGRRIGLRKTLVFYTGRAPHGKKTDWIMHEYRLNDDXVEVPPNTVSTQR

SEQ ID NO: 37174 - DNA, 694 bp, Zea mays
  misc_feature: Ceres CLONE 1422454-F
  misc_feature: Encodes the peptide sequence at SEQ ID NO. 37175
  misc_feature (669)..(669): n is a, c, t, g, unknown, or other
tccccgcggtggcggccgctctagaactagtggatcccccgggctgcaggaattcgcacgagaccattacctagaacatcctaatcgaaaaatcataaaaaaaagacaccctgcgtcatttaccgaccaccgtccatccatggatgcagccgagggccgaggggcagagtgggccgaggggcgtggcaggcggtgagcacgccggtggtcgggacggtacggatctcgtgatccatggccttcgcgggatggcgctgctccctgcttatgacacctcccgttcaccggcagcgaatcggggcttggcatttcccatcaagcattaagcagtgaagcaccccccctcgtttccaccggcagtccggcagcgagcagacagtaacagaatcaggcggtgtcttggaaataacttcagtgccatggcctggtctcatggaacatctccattatttccagtttacaagcttgagcagatcctgatgcgaggaccctccatctgtgatactctcgcacgctgctctcttcaaagaaagtgccctcgctctgatcgtatcatcagcgagcagctggttgactttgtccctgatctcctccttggtgaagacgccccgctcgttggcacggatcctcaagcccgtgccccacacgtcgcagatgtacttctggttncagaactggtcggcaaagtatggcc

SEQ ID NO: 37175 - protein, 91 aa, Zea mays
  misc_feature: Ceres CLONE 1422454-F
  misc_feature (84)..(84): Xaa is any aa, unknown, or other
MAWSHGTSPLFPVYKLEQILMRGPSICDTLARCSLQRKCPRSDRIISEQLVDFVPDLLLGEDAPLVGTDPQARAPHVADVLLVXELVGKVW

SEQ ID NO: 37176 - DNA, 678 bp, Zea mays
  misc_feature: Ceres CLONE 1422458-F
  misc_feature: Encodes the peptide sequence at SEQ ID NO. 37177
  misc_feature (359)..(359): n is a, c, t, g, unknown, or other
  misc_feature (360)..(360): n is a, c, t, g, unknown, or other
  misc_feature (362)..(362): n is a, c, t, g, unknown, or other
  misc_feature (366)..(366): n is a, c, t, g, unknown, or other
ggagctccccgcggtggcggccgctctagaactagtggatcccccgggctgcaggaattcgcacgagaccattacctagaacatcctaatcgaaaaacggccaatggcgaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacgccgccctacagagcgtgcaggggtatagggtgggtcggaagaaaagcgggcggtgggtccctttggagaagtgggtggaagcgnnanttcntcctctccctctccttcccaccgtgcgtcaaggttgccctgcccgccgccccgccccgaatactgccaaccggggtggcgcacccggccggggttccccaagggaaaaaacccccaacccttggcgttgcattgggggaatttaaatttccgtgccccgcgttggttcctttccttccccccccgcccccggggggttcccccccttttgggaacccccacggtgggggaaatttggttataaattttaaaaaaaaacacccggggggggggggtttcccggtttccaaaaaaaaaaaaaaaagcccccccc

SEQ ID NO: 37177 - protein, 98 aa, Zea mays
  misc_feature: Ceres CLONE 1422458-F
  misc_feature (49)..(49): Xaa is any aa, unknown, or other
  misc_feature (50)..(50): Xaa is any aa, unknown, or other
  misc_feature (51)..(51): Xaa is any aa, unknown, or other
MDAAVSTLTALAIFASTVEHAALQSVQGYRVGRKKSGRWVPLEKWVEAXXXPLPLLPTVRQGCPARRPAPNTANRGGAPGRGSPREKTPNPWRCIGGI

SEQ ID NO: 37178 - DNA, 677 bp, Zea mays
  misc_feature: Ceres CLONE 1422459-F
  misc_feature: Encodes the peptide sequence at SEQ ID NO. 37179
aagctggagctccccgcggtggcggccgctctagaactagtggatcccccgggctgcaggaattcgcacgagaccattacctagaacatcctaatcgaaaaatatgtttattaaaaataaaaatgtccgctgcttgcttcgtcccgttctggcgttcacacctctggctgccttcatttcctgttgacgactgagcgggcgagcgccggcgccctttgccaggtccgtcggcccgttagccggcgactagcgcctccctttgccaggtcttcgacgtccccttcgccgtcgactggcgcccagcagccagcagcagatccttttctatctgtcgtgttctgtctgcctggtacatttggaagaatgggggtttaccttagcactccgaaaactgagaaggtatccgaagatggggaaaatgataaacttaaattcggagtttcatctatgcaagggtggcgtacaactatggaagatgctcactcggctttgctagatctcgacaatgacactgcgttttttggtgtttttgatggacatggaggaaaagtagtcgccaaattctgtgcaaaatatctacacagagaagttctcaggagtgaagcctatgcagctggtgacctgggtgctgctgtccacagagcttacttcagaatggatgaaatgatgcgaggtca

SEQ ID NO: 37179 - protein, 104 aa, Zea mays
  misc_feature: Ceres CLONE 1422459-F
  misc_feature: SWISSPROT Homolog: EC 3.1.3.16 Phosphoprotein phosphatase
MGVYLSTPKTEKVSEDGENDKLKFGVSSMQGWRTTMEDAHSALLDLDNDTAFFGVFDGHGGKVVAKFCAKYLHREVLRSEAYAAGDLGAAVHRAYFRMDEMMRG

SEQ ID NO: 37180 - DNA, 643 bp, Zea mays
  misc_feature: Ceres CLONE 1422460-F
  misc_feature: Encodes the peptide sequence at SEQ ID NO. 37181
  misc_feature (617)..(617): n is a, c, t, g, unknown, or other
  misc_feature (620)..(620): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
aagctggagctccccgcggtggcggccgctctagaactagtggatcccccgggctgcaggaattcgcacgagaccattacctagaacatcctaatcgaaaaactcatcaacccacactccagcacacagcaatggcgttcacgcggcgtcatccgtgcggcatcctcctcctctccctgctggcggcatccggctcgctgtcgctggccgccaccggcccgggcgacgtggccgtcttctggggccggaacaaggacgagggcacgctgcgcgaggcctgcgacacgggcacctacaccaccgtcatcatctccttcctccgcggcttcggccacggcgccgcctactactcgctcgacctctcgggccacccgctcgcgggcgtcggcgccgacgtcaagcactggcaggccaagggcatcctcgtgcctcctctccatcgggggggccgcccaaaaccaaaaacccggggccccgggccccgggtaaaaacccccccccccccccccccggggggggggggggggggaaaaaaaacacccccccccccataattttgggggggggggaaaaaacccccaccccatcttgggggggggggcggggccccccccccnccngcggggggggggagnnncccccg

SEQ ID NO: 37181 - protein, 140 aa, Zea mays
  misc_feature: Ceres CLONE 1422460-F
  misc_feature: SWISSPROT Homolog: EC 3.2.1.14 Chitinase
MAFTRRHPCGILLLSLLAASGSLSLAATGPGDVAVFWGRNKDEGTLREACDTGTYTTVIISFLRGFGHGAAYYSLDLSGHPLAGVGADVKHWQAKGILVPPLHRGGRPKPKTRGPGPRVKTPPPPPPGGGGGGKKTPPPP

SEQ ID NO: 37182 - DNA, 698 bp, Zea mays
  misc_feature: Ceres CLONE 1422461-F
  misc_feature: Encodes the peptide sequence at SEQ ID NO. 37183
  misc_feature (397)..(397): n is a, c, t, g, unknown, or other
  misc_feature (410)..(410): n is a, c, t, g, unknown, or other
  misc_feature (436)..(436): n is a, c, t, g, unknown, or other
aaagctggagctccccgcggtggcggccgctctagaactagtggatcccccgggctgcaggaattcgcacgagaccatacctagaacatcctaatcgaaaagacgattccgatcccctcccgtcccgtccatcccgtctcgtctcgcctcgccctccacgccggcgaccggagaaggggccgtgcagcgcaggcgacgcccacaacgaatccgtccccccgcgccggcttcgcccagccccgcggcgacgcaccaggattgaaggaggcatgagaaggtggacatcattgctatagcgatttgattactggagatggtgttggtggtaaagcagcaccgctgcacacactctgcgagctgcgtttgcatcaagggccacctcagtgaggatgctctngtcctcgtctccngccacatgaactggaacccgaggctngatgctatcttgtcgtgtggggtgcaagtggttttgacgaggttgcccaccaggtgctggtggaaggagttctggcctgcaaagggctcccaagaatgatgctgggatttgcattccgggtggcagccccctttggttgatgggaaactggaaaggccctggggaaaccttcctcttttttttgcatggcctgcccaaaaaggggggctggttaaaaaaaatttcccgtttccgggccattttttggtttcaggaaacccct

SEQ ID NO: 37183 - protein, 73 aa, Zea mays
  misc_feature: Ceres CLONE 1422461-F
  misc_feature (33)..(33): Xaa is any aa, unknown, or other
MVLVVKQHRCTHSASCVCIKGHLSEDALVLVSXHMNWNPRLDAILSCGVQVVLTRLPTRCWWKEFWPAKGSQE

SEQ ID NO: 37184 - DNA, 716 bp, Zea mays
  misc_feature: Ceres CLONE 1422464-F
  misc_feature: Encodes the peptide sequence at SEQ ID NO. 37185
  misc_feature (141)..(141): n is a, c, t, g, unknown, or other
  misc_feature (175)..(175): n is a, c, t, g, unknown, or other
  misc_feature (674)..(674): n is a, c, t, g, unknown, or other
  misc_feature (695)..(695): n is a, c, t, g, unknown, or other
aagctggagctccccgcggtggcggccgctctagaactagtggatcccccgggctgcaggaattcgcacgagaccattacctagaacatcctaatcgaaaactctcccctcctcttccacggccgcgcctgcgacacccantccgccgccacgccatggccaagtacaacgtggntgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatggtctcagttgaagagtcttcagaagctgcaaagggcaagtcccaagtgaagttcagtgtgaagaaaaactcaagaatacagataaagagattaaagggcaaaggcaggaagaaagccaaaaatgcaaaaccacctgccaaggagaaagttgatgccatggtagcatgacggacaagactgcatacatccctttgtatgttttctcagagtttgcagcatggaccgacctcaccgaacactggcgcgtgaactgtctcttgcatcttctgcctgaatgctaaatagaagctacttangcctggcgttaatgtacttcnaacatgaatctaccctttata

SEQ ID NO: 37185 - protein, 90 aa, Zea mays
  misc_feature: Ceres CLONE 1422464-F
MSGKRKKKLERRLNRKQKEAAMIKALENNMGDVDMVSVEESSEAAKGKSQVKFSVKKNSRIQIKRLKGKGRKKAKNAKPPAKEKVDAMVA

SEQ ID NO: 37186 - DNA, 715 bp, Zea mays
  misc_feature: Ceres CLONE 1422472-F
  misc_feature: Encodes the peptide sequence at SEQ ID NO. 37187
  misc_feature (404)..(404): n is a, c, t, g, unknown, or other
  misc_feature (405)..(405): n is a, c, t, g, unknown, or other
  misc_feature (413)..(413): n is a, c, t, g, unknown, or other
  misc_feature (414)..(414): n is a, c, t, g, unknown, or other
  misc_feature (417)..(417): n is a, c, t, g, unknown, or other
tggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccataggcttgctaaaaaggtatgggnncttaccannaangacaaaaaggactgggcgtccaaaaatttggatatacagggacaaagttactaatgaaccaaagggtgatgcaacagtcacctatgaggatccacatgctgcttcagctgctgtggaaaggttcgataacaaggatttccctgggagcactattcaggttcacatagctgagtcaaaaagcaaagatgcattcgataaccccacaagtttgaacatcattggtggtgttggtgaacaagatgaactggataatggagcacgcagaggcagagggcgtggtgatggtccaggcaaggct

SEQ ID NO: 37187 - protein, 146 aa, Zea mays
  misc_feature: Ceres CLONE 1422472-F
  misc_feature (14)..(100): Pfam Name: RRM_1 Pfam Description: RNA recognition motif. (a.k.a. RRM, RBD, or RNP domain)
  misc_feature (43)..(43): Xaa is any aa, unknown, or other
  misc_feature (46)..(46): Xaa is any aa, unknown, or other
  misc_feature (47)..(47): Xaa is any aa, unknown, or other
MAGYMSRGPQNGSVYVCNLPPGTDENMLAEYFGTIGLLKRYGXLPXXTKRTGRPKIWIYRDKVTNEPKGDATVTYEDPHAASAAVERFDNKDFPGSTIQVHIAESKSKDAFDNPTSLNIIGGVGEQDELDNGARRGRGRGDGPGKA

SEQ ID NO: 37188 - DNA, 682 bp, Zea mays
  misc_feature: Ceres CLONE 1422478-F
  misc_feature: Encodes the peptide sequence at SEQ ID NO. 37189
  misc_feature (397)..(397): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaacttctagacagcgacgccgtggggagccgccgccgcgcgctccgctcctccctgcacctcatccccttcccctgctccccctcacacgacctgcggcggtgcgaggaccggccttggcaccactcaccagcgcccccggtgcctggagcagtgcagggaggaggagcgggagaagcggcaagagcggagcaggcgcagtgcagggaggaggagcgggagaagcggcaagagcggagcaggcacgaggccgacgactgcagcggcgagggctcgtcggaggatgagcgcgagcgcnagcaggagaaggaggagaagcagaaggaccggcggccgtacatgttcttccgtcgcagcttccgtcgcgtggtccggagcgagcaggggtccctgaggggctcctttggcatcacaggatcccgggaagatcccagaccaatccctggccaacggaaccccagtcaaaattgtccctgcggatttttttttcgctcttttggtgacacgccttcccgggtcctcaccgcggggggagctccgttgatctccctccccccccacagtagggccgggaaaaacttcn

SEQ ID NO: 37189 - protein, 227 aa, Zea mays
  misc_feature: Ceres CLONE 1422478-F
  misc_feature (133)..(133): Xaa is any aa, unknown, or other
KAGAPRGGGRSRTSGSPGLQEFARDHYLEHPNRKLLDSDAVGSRRRALRSSLHLIPFPCSPSHDLRRCEDRPWHHSPAPPVPGAVQGGGAGEAARAEQAQCREEEREKRQERSRHEADDCSGEGSSEDERERXQEKEEKQKDRRPYMFFRRSFRRVVRSEQGSLRGSFGITGSREDPRPIPGQRNPSQNCPCGFFFRSFGDTPSRVLTAGGAPLISLPPHSRAGKNF

SEQ ID NO: 37190 - DNA, 602 bp, Zea mays
  misc_feature: Ceres CLONE 1422484-F
tccccgcggtggcggccgctctagaactagtggatcccccgggctgcaggaattcgcacgagaccattacctagaacatcctaatcgaaaacccactctccctttccactctcaggctcccactccccccctaccggctaccctacccatcacacacaaacagccactcctcacctcccccgtcctccggttcatgtcctgctgctccccatgtcgcccccactcgacctcgactacataagcctctcgccggcggcggctgccgccccctgcccaacaacaacctggaaggggtacccgaagctccgcccctggtcctgcccgggggtcccggtttccccccaaaccccccttttttggttgtttgccaccccggaaaccacccctggaaccttcctccccgggtaaaggggcccccaaaggcggggtttttttcaaacagaggggccaaaacccatatatccggggggggaatttttctgggaaaggggaaaaaaaaggtaccccgaaaaagaaaacaccacaacaaaaaaagggtctcagaaccaccccccctaagacgggggcggcaaaataaaaaaaaaaggggggcggggtgggag

SEQ ID NO: 37191 - DNA, 662 bp, Zea mays
  misc_feature: Ceres CLONE 1422489-F
  misc_feature: Translation starting site: 173
  misc_feature (325)..(325): n is a, c, t, g, unknown, or other
atagctggagctccccgcggtggcggccgctctagaactagtggatcccccgggctgcaggaattcgcacgagaccattacctagaacatcctaatcgaaaacaaaccctagcccagagcagccgcatcgaactctacctgcctttctctcgtccctggcggcggcggcaggatggcggcttctactgcgaggacggtgaaggatgtgaacccccacgagtttgtcaaggcctactccgccccatctcaaacgctccggcaagatggagcttcctgagtggggtgacattgtgaagactgcgaggttcaaggagctccctccctnatgaccctgactggtactacatcagggctgcctcttgtacaaggaggatctaccttgaaacaagggcattggtgttggtgggcttccaaaaaatttttgggggccccccagaagaaagggttcacccccccccccctttttctttaaaaaaaacaggggggggcccttttttacgcaaaaaattctccccccaaaaaatttttgggggaaaaagggggcccccttttgtggggggccccccccccccccgggggggggggggggggggggggttttccacccccccccccgcgcggggggaagggggggtggttttttttttttttaaaacaacagg

SEQ ID NO: 37192 - DNA, 674 bp, Zea mays
  misc_feature: Ceres CLONE 1422498-F
  misc_feature: Encodes the peptide sequence at SEQ ID NO. 37193
aaagctggagctccccgcggtggcggccgctctagaactagtggatcccccgggctgcaggaattcgcacgagaccattacctagaacatcctaatcgaaaagtccgccccagtctaatccgattcaaaccgcccgttccccgtgtccgtgccaagcaagccgagcccaacccccaagagccagctgctcggtgctccacgcgatggcgcagaaggagactaatggcagcaacggcgatcacatctccacccgcccgccgccgaccccctcgcccctccgcttctccaagttctttcaggctaacctgcggatcctggtcactggtggggcgggcttcatcggctcgcacctcgtagacaagctcatggagaacgagaagcacgaggtcattgttgctgataactttttcactggcccacaagacaacctgaagaagtggattggccacccaagatttgagctcatccgtcatgatgtcaccgagccgcttcttgtggaagttgaccaaatctatcacctttgcttgccctggttcaccaatcttctacaagcacaaccctgttaagaccatcaaagacaaatgttatttggtaccctgaaacatgcttaggaccttgacaaagagagtttggagcctagaaatttttttcgacatcaaccctctgaaagttta

SEQ ID NO: 37193 - protein, 120 aa, Zea mays
  misc_feature: Ceres CLONE 1422498-F
  misc_feature: SWISSPROT Homolog: EC 4.1.1.35 UDP-glucuronate decarboxylase
MAQKETNGSNGDHISTRPPPTPSPLRFSKFFQANLRILVTGGAGFIGSHLVDKLMENEKHEVIVADNFFTGPQDNLKKWIGHPRFELIRHDVTEPLLVEVDQIYHLCLPWFTNLLQAQPC

SEQ ID NO: 37194 - DNA, 677 bp, Zea mays
  misc_feature: Ceres CLONE 1422506-F
  misc_feature: Encodes the peptide sequence at SEQ ID NO. 37195
ctccccgcggtggcggccgctctagaactagtggatcccccgggctgcaggaattcgcacgagaccattacctagaacatcctaatcgaaaaaccctcagcacgccgccgctacagcccgcacctcgtttcctctcccgtctccgagatgacgaagcgaaccaagaaggccggaattgttggcaaatatggaaccaggtatggtgctagcttgcgtaagcaaatcaagaagatggaggtatctcagcactccaagtatttctgtgagttctgtgggaagtttgctgtgaagaggaaagcggttgggatttggggatgcaaagactgtgggaaggtcaaggccggtggtgcttacaccatgaacactgctagtacggtcactgtcaggagcacgatccctcccttgaaggagcagaactgaccttgatccgccccttgtcagggatactgggggccactatattgggttgtgaagccgagccagacctccacctttttgtgggtatgcccctagggatcctaaagggtgggggggcaaaaatttcaccttggtttcccgttgggaaatttccacagggattacttggacccttttcccatccggggggcaccccaaaatttccctttcgggtttccccccctttggggttcacaaaaaaaaaaaaaaaaagaaatttg

SEQ ID NO: 37195 - protein, 90 aa, Zea mays
  misc_feature: Ceres CLONE 1422506-F
  misc_feature (2)..(91): Pfam Name: Ribosomal_L37ae Pfam Description: Ribosomal L37ae protein family
MTKRTKKAGIVGKYGTRYGASLRKQIKKMEVSQHSKYFCEFCGKFAVKRKAVGIWGCKDCGKVKAGGAYTMNTASTVTVRSTIPPLKEQN

SEQ ID NO: 37196 - DNA, 635 bp, Zea mays
  misc_feature: Ceres CLONE 1422507-F
  misc_feature: Encodes the peptide sequence at SEQ ID NO. 37197
  misc_feature (395)..(395): n is a, c, t, g, unknown, or other
  misc_feature (396)..(396): n is a, c, t, g, unknown, or other
  misc_feature (411)..(411): n is a, c, t, g, unknown, or other
aagctggagctccccgcggtggcggccgctctagaactagtggatcccccgggctgcaggaattcgcacgagaccattacctagaacatcctaatcgaaaaacaccaacaaaccaaacaccatccgccacgaccacgactccacgagagagcggaggaggagggggagcaatggcagagccgggccagcagttgctgcggtcgttcgtggaggtggcagcgggctcgcacttccctatccagaacctgcccttcggggtcttccgccggcgggggtcgccaccgcaggctccgctccccccggtggccatcggggacttcgcgctcgacctcgccaccgtcgccgacgcgggtctcttcgacgggcccgcgctctccggctccccgtgcttccanncaggagacgcttcancattgtttcttttggggatgggccacccggttggaaggggggcgcgccccccttaaaaaaattcttttaccaaaaaacattttttggggaaaacaaaaccccgaggaaaaaaaggttttttccccaggggggatccgggggggtttcccccacccgggggggggggtacacaaattttttttttttttttgccccccgggaggggacggggaatttcttttccg

SEQ ID NO: 37197 - protein, 98 aa, Zea mays
  misc_feature: Ceres CLONE 1422507-F
  misc_feature (11)..(97): Pfam Name: DUF1969 Pfam Description: Domain of unknown function (DUF1969)
  misc_feature: SWISSPROT Homolog: EC 3.7.1.2 Fumarylacetoacetase
  misc_feature (75)..(75): Xaa is any aa, unknown, or other
  misc_feature (76)..(76): Xaa is any aa, unknown, or other
  misc_feature (81)..(81): Xaa is any aa, unknown, or other
MAEPGQQLLRSFVEVAAGSHFPIQNLPFGVFRRRGSPPQAPLPPVAIGDFALDLATVADAGLFDGPALSGSPCFXXGDASXLFLLGMGHPVGRGARPP

SEQ ID NO: 37198 - DNA, 669 bp, Zea mays
  misc_feature: Ceres CLONE 1422508-F
  misc_feature: Encodes the peptide sequence at SEQ ID NO. 37199
atagctggagctccccgcggtggcggccgctctagaactagtggatcccccgggctgcaggaattcgcacgagaccattacctagaacatcctaatcgaaaaaattcacgcccccaccacgacttccgtgctcgccgccttctcggactaggggggttcggctcgagatctgatttcgggcgccggaggactacatggaggttagggagatggcgatggccgcggcggctgcggctgcagagtccggcgggggaggcgtcaagctgccgccgcccaatcccaacctgccctacagggaggactgctggagcgacggctagacggcagctctcgtctccgcctggggcagccgctacgtcgagctcaaccgcggtaacctgcgccagaagcagtggcaggaggaggcggacgccgtcaactcgcgccggggagcctccgcgcggtgccgcccgccgcgcaccgacatccagtgcaagaaccgcgtcgataccctcaagaagaagtacaaggtcgagctcgcccgcaacgagccgtccgcctggtcctactttcccgagctcgaccgcctcgtcggcacaaccctcagcgactcccgctccaagagacccatgggcgtctctgcctcgtcaattcgctttgcccatgcatccaccagccgtgcgaaggccc

SEQ ID NO: 37199 - protein, 41 aa, Zea mays
  misc_feature: Ceres CLONE 1422508-F
MEVREMAMAAAAAAAESGGGGVKLPPPNPNLPYREDCWSDG

SEQ ID NO: 37200 - DNA, 833 bp, Zea mays
  misc_feature: Ceres CLONE 1422509-F
  misc_feature: Encodes the peptide sequence at SEQ ID NO. 37201
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (15)..(15): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
nnncccccccccccncccacccgccccccccgcgcccggatgnnnnntnttcaagctggagctccaccgcggtggcggccgctctagaactagtggatcccccgggctgcaggaattcgcacgagaccattacctagaacatcctaatcgaaaaagtactttcgctagctcccttccgttcccttcccacgaaaaccggagagggagtgagaagaagcaacaagaagcggagagccaacgcgcaacgcaacgccctgagatggcggcgccggcgccggcgccgaagcaggaggagctgcagccgcacgccgtcagggaccagctgccctccgtctcctactgcctgacaagcgcgcccccatggccggaggccgtcctcctcggcttcatgcactacctcgtaagggtggagaccaccgtcgatcatcgccaccgctgctcgatgccccagagggggcggggggtaaaggacgacaaccgcccgaggagcaagcgaggccaattgcggggtctctgggaccggagaatcaaccccgcctgggtcccagagcccttgcggtgggcgatcgcccccttcccctcgttccggtcttggggcgggcctccacatacaacgcagacagcacccggcccaacccatctatgtctttcgtgagctccccccggggcccggggcaacaggggaggcatttctcccggaccccccctctggaggaacaattttaatgggcggagtcgatgtggcaggcgggtaccaccacagggagcgccgattctatgtggatggggcgttccggggcgtatctgtgaagttctcctcttgggtgcctccg

SEQ ID NO: 37201 - protein, 131 aa, Zea mays
  misc_feature: Ceres CLONE 1422509-F
MAAPAPAPKQEELQPHAVRDQLPSVSYCLTSAPPWPEAVLLGFMHYLVRVETTVDHRHRCSMPQRGRGVKDDNRPRSKRGQLRGLWDRRINPAWVPEPLRWAIAPFPSFRSWGGPPHTTQTAPGPTHLCLS

SEQ ID NO: 37202 - DNA, 637 bp, Zea mays
  misc_feature: Ceres CLONE 1422510-F
  misc_feature: Encodes the peptide sequence at SEQ ID NO. 37203
aaagctggagctccccgcggtggcggccgctctataactggtggatcccccgggctgcaggaattcgcacgagaccattacctagaacatcctaatcgaaaaaattcgccttcacctcgccgcttcctccttgaccgccaccgttgacgtcgtcttccggcgaggtagctcgccggaagacctcacctggacttttccgacgcaccctccacacgctctttaaccctccggaatgggcgcctgcttctagctcgtctacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggacaccgcttctcctccgcctccgcctcgggcagccgcctcctccatgacggcgcctggcgccccttctgcatattcacctccacccgccagcccgagcagcaccgcggtagcggcagcgaccggcatgactgaggcgactactacatccgaagccccaagccatcgcgcgcggagctcactcgttgctgctcacgcgtgcgtgcttatcgtccagtcgccgcccgcgtctcttgg

SEQ ID NO: 37203 - protein, 65 aa, Zea mays
  misc_feature: Ceres CLONE 1422510-F
MAIRITVSYSGYVAQNLAASLGHRFSSASASGSRLLHDGAWRPFCIFTSTRQPEQHRGSGSDRHD

SEQ ID NO: 37204 - DNA, 682 bp, Zea mays
  misc_feature: Ceres CLONE 1422511-F
  misc_feature (393)..(393): n is a, c, t, g, unknown, or other
  misc_feature (657)..(657): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacggcgcntttcccttgttcgggggaggaggcggtggtggtgtaccagagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgccttcgacgactgcgtcgtcaagggcggcgccgccttggacccagcgagaccgtctccttcagtactccnactccttctcctacagctcagtgtn

SEQ ID NO: 37205 - DNA, 674 bp, Zea mays
  misc_feature: Ceres CLONE 1422513-F
  misc_feature: Encodes the peptide sequence at SEQ ID NO. 37206
aaagctggagctccccgcggtggcggccgctctagaactagtggatcccccgggctgcaggaattcgcacgagaccattacctagaacatcctaatcgaaaactcctcgcggctcatagaaacctcaaaacccaaccaggacagcgtccacagaaagaagagagagcacatagagtggagtggtggacagaccatggagctctgcgtctctacacccccatcctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtcacggacaagcccgatacgcctgcccacgacaagggccaagagggtaccgccgccccctagtggctccggcgaaggcgcctatggaagaccttggtgccgccaaaggcgtcatcatcccccagatgatgggcggccctgaatgaaaattctaagccaaggttggaaaaaaaaattggaggcttattcctccttaccattaaggcccttgccaaaaaaccaaatttttgggacctccttggccaagaatttgacctcccccttggatacccct

SEQ ID NO: 37206 - protein, 89 aa, Zea mays
  misc_feature: Ceres CLONE 1422513-F
MELCVSTPPSSVRATAAPISFAPPRRGASASTAVPPHRRIPTRGWRCASAAVPGPVPSEEPASASYAVVVTDKPDTPAHDKGQEGTAAP

SEQ ID NO: 37207 - DNA, 798 bp, Zea mays
  misc_feature: Ceres CLONE 1422516-F
  misc_feature (36)..(36): n is a, c, t, g, unknown, or other
  misc_feature (40)..(40): n is a, c, t, g, unknown, or other
tttttttttttttttttttttttattagtggagggngggngacttagcccgcgggggggcgagccccccccaagggggggggccggcgccaaagctgggactccccgcggtggcggccgctctagaactagtggatcccccgggctgcaggaattcgcacgagaccattacctagaacatcctaatcgaaaaaaaaaccgcaccgcaccgcaacgcgccaccgatccaccccgcgtcctcggcctccctcccctccggcgagcggcggcgcgggcgggccatggagggggttctactacgtcgtgttcggggcgccctgggcgcccattcggggcgggggttcagagttcggcaaaaaccggtaaggaaccccgtgcgccactaaccttccggcttttaaactcctttaaaaaaaaaaaataaggtccctccgtctaacccccttaaaaaatggcccggggggaaatgggttttttaaggggcccccccagcgggtttaaaaaaagctttataagggggggggagggggggttcttcacaaagggggggggaaaaattgtggggcgccctttttttttactgcgcgggtctttcaaacaccctggtgggggtccctcggagaaccccctctgtggtgtcccccccctgcaaaaaaaaaagaggcccccagaagagggcgcctaagacccccccccgggtggagacgtacaatttcttgatgggggggttgaacgaaaagccctccccccccggaagaaagggggtctctcttaaggggggggctgctttttggggggg

SEQ ID NO: 37208 - DNA, 668 bp, Zea mays
  misc_feature: Ceres CLONE 1422519-F
  misc_feature: Encodes the peptide sequence at SEQ ID NO. 37209
  misc_feature (418)..(418): n is a, c, t, g, unknown, or other
  misc_feature (419)..(419): n is a, c, t, g, unknown, or other
  misc_feature (448)..(448): n is a, c, t, g, unknown, or other
  misc_feature (458)..(458): n is a, c, t, g, unknown, or other
  misc_feature (459)..(459): n is a, c, t, g, unknown, or other
  misc_feature (480)..(480): n is a, c, t, g, unknown, or other
  misc_feature (484)..(484): n is a, c, t, g, unknown, or other
  misc_feature (485)..(485): n is a, c, t, g, unknown, or other
  misc_feature (490)..(490): n is a, c, t, g, unknown, or other
  misc_feature (499)..(499): n is a, c, t, g, unknown, or other
ggagctccccgcggtggcggccgctctagaactagtggatcccccgggctgcaggaattcgcacgagaccattacctagaacatcctaatcgaaaacgaacacaccagaccagctcatcatcacattcgcatacatctcttctagcacgcaaagatcgagctatagctagctctgcaaccagagacaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaagggggcaagaggcgcgccaccgccgatgccgtggaagaagccgccggcgcccgagaagcnnagcagcgtgacgccgaagacggcgccccnggcagccaanngcgcccgtggtggggtggccngccnngtgangtcctaccngaaagaactgctttccagcagggccagcaggccaggcagggcggcgggcgggccaaaccaggaaggcggcgggccggcggcgggcgggccccccgggtttgcccgggaatttctttagggaagcccccccccaaaaaaaacccaaggaagtttggtggaaaagaggccc

SEQ ID NO: 37209 - protein, 61 aa, Zea mays
  misc_feature: Ceres CLONE 1422519-F
  misc_feature (59)..(59): Xaa is any aa, unknown, or other
METVVGDLMATELRLGLPGTVDDCSQPQLVKATPPSTPRGQEARHRRCRGRSRRRPRSXAA

SEQ ID NO: 37210 - DNA, 704 bp, Zea mays
  misc_feature: Ceres CLONE 1422524-F
  misc_feature: Encodes the peptide sequence at SEQ ID NO. 37211
caaagctggagctcaccgcggtggcggccgctctagaactagtggatcccccgggctgcaggaattcgcacgagaccattacctagaacatcctaatcgaaaaagttaggcccataagcgtgcccgttctttttcgcgtttcacggcggcgcggacagagagccatcggcggcgcaccgaccgccggcgaagggtacagagatgaccacggttagcctcggcgcctctaggccttccactgtcaacttccgcatgccgacgagggacaacctcgtgcctatacgcgtcgacgtcgaggtggacggccagcgctacagggacgccttcccctggaacccgcgagatccccactcggagataatcaccttcgcctaagcggacgggccaagaactccaggctggcgggccaattttcgtccccccagaggctccggcccatccaggggcaaacctgccgaagttcccttcccaccaaggggcgggagaagccaaatcaaaagaaagattgtggccccctaaaaaggaccctcccaaggaaaccacccgtgaattaggggccccattcttaatggggatttcggcacccccttaataagggacccccaaaaaaattcgccaaaaccccggggggggggagtttggaaaatttcccccccccccgaaagtggggccccccaaaaaaccagtttccccccccccggaac

SEQ ID NO: 37211 - protein, 57 aa, Zea mays
  misc_feature: Ceres CLONE 1422524-F
MTTVSLGASRPSTVNFRMPTRDNLVPIRVDVEVDGQRYRDAFPWNPRDPHSEIITFA

SEQ ID NO: 37212 - DNA, 692 bp, Zea mays
  misc_feature: Ceres CLONE 1422527-F
  misc_feature: Encodes the peptide sequence at SEQ ID NO. 37213
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcccgaggacctagtcaagcaggtgaggcacgcggccggggaccgtgggctttcttctggctggtgaacccccgaagtgcccggaggagctgaagggccgcatgcctcccccggggtggccccatttccaccaagggccccctgggaagcaaagccgggccctctcctccaagggacctcccctcgcaaccgtgggcttccccctcaactttcaacctctttcaagggtgcttgcggccgaactggccccaacccttctcttctgccgaggtgggtccccaaccccgcccccccccgggaaaag

SEQ ID NO: 37213 - protein, 102 aa, Zea mays
  misc_feature: Ceres CLONE 1422527-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRPEDLVKQVRHAAGDRGLSSGW

SEQ ID NO: 37214 - DNA, 721 bp, Zea mays
  misc_feature: Ceres CLONE 1422533-F
  misc_feature: Translation starting site: 196
  misc_feature (528)..(528): n is a, c, t, g, unknown, or other
  misc_feature (575)..(575): n is a, c, t, g, unknown, or other
  misc_feature (645)..(645): n is a, c, t, g, unknown, or other
  misc_feature (652)..(652): n is a, c, t, g, unknown, or other
  misc_feature (674)..(674): n is a, c, t, g, unknown, or other
  misc_feature (721)..(721): n is a, c, t, g, unknown, or other
aagctggagctccccgcggtggcggccgctctagaactagtggatcccccgggctgcaggaattcgcacgagaccattacctagaacatcctaatcgaaaaagttcgaaaggttcaacttcaaacacactccaaactccaagcctcaataatctcgacctctgtaatgaccaagaagctcatctccatctccaccatggccgggaagcaaggttgcaaggagcagtccaatgatcggaggatccaggcttcgatccaaggagacgccaagagcgtggtggtggggttcggcggcaggctggtcacccgtgagcaggagcaggaggacgccatcatcgtcgcggcgctgcggcacgtggtgtccgggtacagcacgccgccgccggaggtcgtcgtcacggtggcgggcggggaggcgtgcgggacctgcggcatcgacgggtgcctcggctgcgacttcttcggggcgccggagctggcgcaggaggcagtgtcctgcggcacagggcaggtggcgacgacggcgtcngtcgggggcggggcagcggcggcggcgctgaagcccccggcgcgtangacaggtacatgtaccgcggcgtgcggcagcggccgtggggcaaagtgggcggcgagatccgcgacccgncgcgcgncgcgcgcgtgtggctgggcacnttcgacaccgcgaagaagccgcaggggctacgatgccccgcggtcan

SEQ ID NO: 37215 - DNA, 729 bp, Zea mays
  misc_feature: Ceres CLONE 1422538-F
  misc_feature: Encodes the peptide sequence at SEQ ID NO. 37216
atagctggagctcaccgcggtggcggccgctctagactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggaacgccgacgtcttccgcgtccccgccggggtaacaatgcccccccagcagcgtgcacatcccccctcgcttgaccagggaggggccccgccaattgatccttgtccgtgggttgacccgcccaatgagtgtggggcagcaggcccccgttcttgttcccagcggagggcgttccccccgaaccccggtaaaaagaatgggagctctccgggccggaaggggcccccccaccccgcgccttccaacttactttcaaacctcaccccttccgggctttccttccccccacctggccccccctcccaaaatcgctctatgccattcgctctccaaggtttctctcttcccccccctggggggtttcgtccctccccgcggggggaggatccttttttgttttcactcattgctccgtt

SEQ ID NO: 37216 - protein, 72 aa, Zea mays
  misc_feature: Ceres CLONE 1422538-F
MSNMLRARRRLDLLQVVLFAAVLLVVVADAGVTSQYRRKLEATVEMPLERRRLPRPRRGNNAPPAACTSPLA

SEQ ID NO: 37217 - DNA, 695 bp, Zea mays
  misc_feature: Ceres CLONE 1422541-F
  misc_feature (518)..(518): n is a, c, t, g, unknown, or other
  misc_feature (555)..(555): n is a, c, t, g, unknown, or other
  misc_feature (598)..(598): n is a, c, t, g, unknown, or other
  misc_feature (626)..(626): n is a, c, t, g, unknown, or other
  misc_feature (629)..(629): n is a, c, t, g, unknown, or other
  misc_feature (658)..(658): n is a, c, t, g, unknown, or other
ctccccgcggtggcggccgctctagaactagtggatcccccgggctgcaggaattcgcacgagaccattacctagaacatcctaatcgaaaaatttgaacctccaagttcagaaactgaccccctcgtccctccccaccatcgcgatggctgacgacgccgcggcggcggcgttcgcgccctctccctcgccaccgtcacccgtagcgcaacctctgcccgacctctccccgccgccgcccttctccccaccagccggcacccctgcttccggggcgcagacgccgagcctcccggacaccccggcctccctagatccggacacccccttctccgacgccaccccgacccccgccgacgcctccgacgccgccctcgcttcggacgacggcatcaccaacccgtcggggggcaccgccggcaagcacatgacgctcgcgccgcccgccccgcccgcaagaaaccgtccaagaagaagggcggcaacagcgtctggacccgcccggcctcccgcaaggncaagagaaggcgaggcagccgggcgggcctcgccacngctccggcggccccgccggggccgccagaggctccaaccctangcccacgccggcggcgaggaggagtccntcntcgtccccgcgaccggcttggcgccgagngctccgagacgcgcccgccagcctgtgctctctcccg

SEQ ID NO: 37218 - DNA, 589 bp, Zea mays
  misc_feature: Ceres CLONE 1422547-F
  misc_feature: Translation starting site: 198
  misc_feature (224)..(224): n is a, c, t, g, unknown, or other
agctggactccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctgggnagccaccaggaggtgtaccacccgggcgccctcaaggcggcgttcgctgagttcatctccaccctcatcttcgtcttcgcggccagggctccggcatggccttcagcaagctgaacgggggcggcccgacgacccgggggggcctgatcccggcgggggtggcccacccttccgccttttccttggcgggttcttggggccccaaaattttccggggggaacttaaaccctgggcgggagactttgggccttttttgggggggggaaaaattcccccttttcccggggggccccctttatttggggggggcccaccctgtgggggggccaccccggggggggggttttcccccgccccccctttc

SEQ ID NO: 37219 - DNA, 675 bp, Zea mays
  misc_feature: Ceres CLONE 1422549-F
  misc_feature: Encodes the peptide sequence at SEQ ID NO. 37220
ctggagctccccgcggtggcggccgctctagaactagtggatcccccgggctgcaggaattcgcacgagaccattacctagaacatcctaatcgaaaaaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgagaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctgccgtgttatagccagattaaagaaggaaagagatgacgctagagcacttttggctcaagctgagagacagattcctgcgtcagttgcaggagctgctcctgcagctgttgtttccatggaaaagagtaattgaagatgaaattggccctgacg

SEQ ID NO: 37220 - protein, 109 aa, Zea mays
  misc_feature: Ceres CLONE 1422549-F
  misc_feature (18)..(87): Pfam Name: Prp19 Pfam Description: Prp19/Pso4-like
MDDIVPVKTNTIVKPRPLQAASIPGLLGIFQNEWDALMLSNFALEQQLHTARQELSHALYQHDAACRVIARLKKERDDARALLAQAERQIPASVAGAAPAAVVSMEKSN

SEQ ID NO: 37221 - DNA, 729 bp, Zea mays
  misc_feature: Ceres CLONE 1422559-F
  misc_feature: Encodes the peptide sequence at SEQ ID NO. 37222
  misc_feature (517)..(517): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (549)..(549): n is a, c, t, g, unknown, or other
  misc_feature (551)..(551): n is a, c, t, g, unknown, or other
  misc_feature (552)..(552): n is a, c, t, g, unknown, or other
  misc_feature (556)..(556): n is a, c, t, g, unknown, or other
  misc_feature (557)..(557): n is a, c, t, g, unknown, or other
aaagctggagctccccgcggtggcggccgctctagaactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgtcgcatcggcggcggcaagagcaacgccccgcgactgcgacactactgccgccttcgcggcgggcgacggcagtgccggcgccgtggacgaggacgacgagcaggccaagaccgccgacgtgttcggtgggcggaccggcggcggcggcctcttcggcggcgtccacggcccgctgggcggcggcgtcgctgggttcggcccgttcggcggggccgtcgccggcgcgggcccgttcggcgggttcggaggggcgcgctcngtggggggggaggagaggaggannnnngagancnngtgnnccccgcgtcccttgagtcttgaacaacgctgtgcatggccatgaatgcatgcgtgcgtgcgcgtgtaataaggcgtggctgtactctgtactgtacgtacatgcccgtgtgcctgtcccgctcttgtgatgaaggattgggcgtacgtatgtccgtatgggcatgcatgtgt

SEQ ID NO: 37222 - protein, 130 aa, Zea mays
  misc_feature: Ceres CLONE 1422559-F
  misc_feature (111)..(111): Xaa is any aa, unknown, or other
  misc_feature (112)..(112): Xaa is any aa, unknown, or other
  misc_feature (114)..(114): Xaa is any aa, unknown, or other
  misc_feature (115)..(115): Xaa is any aa, unknown, or other
  misc_feature (116)..(116): Xaa is any aa, unknown, or other
  misc_feature (117)..(117): Xaa is any aa, unknown, or other
MAAKWWLVASLLLCLAVASAAARATPRDCDTTAAFAAGDGSAGAVDEDDEQAKTADVFGGRTGGGGLFGGVHGPLGGGVAGFGPFGGAVAGAGPFGGFGGARSVGGEERRXXEXXXXPRPLSLEQRCAWP

SEQ ID NO: 37223 - DNA, 714 bp, Zea mays
  misc_feature: Ceres CLONE 1422566-F
  misc_feature: Encodes the peptide sequence at SEQ ID NO. 37224
  misc_feature (578)..(578): n is a, c, t, g, unknown, or other
tggagctccccgcggtggcggccgctctagaactagtggatcccccgggctgcaggaattcgcacgagaccattacctagaacatcctaatcgaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacagctcagcacagtgacatgcgctgcagcatcactgctgccaccagatcaggcatgtggagccgctgcaccggtaccatgcgacatacggtgtggatctgcagtccttactgcancagcagccgcagggagagcccgctgcgctgatggcagccctggtagcgcagcagctgacagcgatgttgcgcctgcagctgcaacagccagttccctagccttgcacgcagctgccggtcgtgtctactactgata

SEQ ID NO: 37224 - protein, 105 aa, Zea mays
  misc_feature: Ceres CLONE 1422566-F
MKVLIVALALLALAASAASSTSGGCGCQTPPFHLPPPFYMPPPFYLPPQQQPQPWQYPTQPPQLSPCQQFGSCGVGSVGSPFLGQCVEFLRHQCSPAATPYSSAQ

SEQ ID NO: 37225 - DNA, 587 bp, Zea mays
  misc_feature: Ceres CLONE 1422581-F
  misc_feature: Translation starting site: 205
  misc_feature (45)..(45): n is a, c, t, g, unknown, or other
  misc_feature (302)..(302): n is a, c, t, g, unknown, or other
  misc_feature (314)..(314): n is a, c, t, g, unknown, or other
  misc_feature (389)..(389): n is a, c, t, g, unknown, or other
  misc_feature (403)..(403): n is a, c, t, g, unknown, or other
  misc_feature (430)..(430): n is a, c, t, g, unknown, or other
  misc_feature (495)..(495): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (506)..(506): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (519)..(519): n is a, c, t, g, unknown, or other
  misc_feature (521)..(521): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (540)..(540): n is a, c, t, g, unknown, or other
  misc_feature (547)..(547): n is a, c, t, g, unknown, or other
ggcggccgctctagaactagtggatcccccgggctgcaggaattncacgagaccattacctagaacatcctaatcgaaaactatcatcatccaatccagatcagcaaagcggcagtgcgtagagaggatcgtcgaacagaacagcatgaagatggtcatcgttctcgtcgtgtgcctggctctgtcagctgccagcgcctctgcatgcagatgccctgcccctgcgcggggctgcagggcttgtacggcgctggcgccggcctgacgacgatgatgggcgccggcgggctgtacccctacgncgagtacctgangcagccgcagtgcagcccgctgggcggcgcgccctactacgccggggtgtggccagacgagcgccatgtacccanccggcttccgggcnaacagggtgcttggccccgcccgcccnaatggggggtttttttggggaccttttccaattcccccctcccccccccaaaaaaaattttgttnaannnaatttntttttnnnttttntntatnnnnnnnncnnnnntncttggtngtgtggggggctcccgcccccccccccccggccccccccg

SEQ ID NO: 37226 - DNA, 676 bp, Zea mays
  misc_feature: Ceres CLONE 1422582-F
  misc_feature: Encodes the peptide sequence at SEQ ID NO. 37227
aagctggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgatcttgtccccttcaccaacaaggtgtacaacggcagcctggacaagcggctgggcgtcaccgcgggcatctgcgtgctcatccagcacgtccccgaccgcaacggcgaccgctacgaggccatctacagcttctacttca

SEQ ID NO: 37227 - protein, 144 aa, Zea mays
  misc_feature: Ceres CLONE 1422582-F
  misc_feature (59)..(144): Pfam Name: Allene_ox_cyc Pfam Description: Allene oxide cyclase
  misc_feature: SWISSPROT Homolog: EC 5.3.99.6 Allene-oxide cyclase
MAAALRCPASVRVSGPAAAGLAKVRQASRVVAVSGARQSRSGGVAVRASLFSPKPAAAKDARPTKVQELYVYEINERDRESPAYLRLSAKQTENALGDLVPFTNKVYNGSLDKRLGVTAGICVLIQHVPDRNGDRYEAIYSFYF

SEQ ID NO: 37228 - DNA, 697 bp, Zea mays
  misc_feature: Ceres CLONE 1422583-F
  misc_feature (462)..(462): n is a, c, t, g, unknown, or other
  misc_feature (546)..(546): n is a, c, t, g, unknown, or other
  misc_feature (573)..(573): n is a, c, t, g, unknown, or other
  misc_feature (632)..(632): n is a, c, t, g, unknown, or other
ctccccgcggtggcggccgctctagaactagtggatcccccgggctgcaggaattcgcacgagaccattacctagaacatcctaatcgaaaagcagccgccgccgccgcctctctctcccttccctcttctctctgccctcacctctctcccccttccatcacctcgctagtaacaggtcaccgtgtgtgtgcgcgccatggggattcatctgccgccgcctgccctcgccttctgcctctcggcgcccactcggttctagtggccgcttcgaggaggcgctcgcgcgcatcgaggagctccaggagcgcgacactggcgccgacgatagcagcacagcctcgtcgttcttgagcgacggagaggcggcgtcgcggccagcaggcgagcagcagtcgcactccgcagatttcttgagcgacggagaggcggcgtccgggggcattcagagacgtgcgtgacngtcggaggtcgtcgagcgcgtctagatagcatccaagacaaatagcgtttgtcgcgatctgaggcagctggtaggcagtctggnctttgggcgcacgcaagcaaaagaggnagggctgggagcacgtcatctccaagagcagcgacgacgtctcctacagggctggtgcnaccagcccacggtagtttgcaattgcgtacatgcatggcaacagatctgggctctagaagctgct

SEQ ID NO: 37229 - DNA, 673 bp, Zea mays
  misc_feature: Ceres CLONE 1422592-F
  misc_feature: Encodes the peptide sequence at SEQ ID NO. 37230
  misc_feature (344)..(344): n is a, c, t, g, unknown, or other
  misc_feature (345)..(345): n is a, c, t, g, unknown, or other
ggagctcaccgcggtggcggccgctctaaactagtggatccccgggctgcaggaattccgcgagacccttacctagaacatccttatcgaaaaaaaccggtgtggcttggctcggctcaactcaactcaactcaactcggcgaataaggttttgtaccgccgtggatatctccgtccccgccatggacgtctcgcacgcgggatcctccctcgccggcgaggctccgaccaccggggagcaccggatggggactaccatcctccgggtctgctactagggcggcgtcgtcctgtgcgccgattccaggaccagcactggaatgtatgtagcccaccgtgcctcnnacaagaatactcaactgacaaacaatgtggatgtctgtcgctcttgatctgctgctgatacacaatcatttcggaatatgttacctatttcctccccaccccccaatccaccttgaacaacagctaccgtttaaattgcaaccaactgaatagggtggttggttttccaaccaaaaaaattttcaaacctgccctttttttttgggggtggggaaaatcccagggggcccaattttttctaaccccctccggggggaaattttttaaaaaccctttttaatatggggggtggggggcccagcaccataaacccctttttttaataaaa

SEQ ID NO: 37230 - protein, 31 aa, Zea mays
  misc_feature: Ceres CLONE 1422592-F
MDVSHAGSSLAGEAPTTGEHRMGTTILRVCY

SEQ ID NO: 37231 - DNA, 632 bp, Zea mays
  misc_feature: Ceres CLONE 1422595-F
  misc_feature: Encodes the peptide sequence at SEQ ID NO. 37232
aaagctggagctccccgcggtggcggccgctctagaactagtggatcccccgggctgcaggaattcgcacgagaccattacctagaacatcctaatcgaaaaataccatgtccgactacaaccgctacggccacagctacagctacggcggcgggtacggccaagggccagcgccctcggccccgccggcaccgcacatgcccaccgctacatccgccgccccgccctcctcctcctcatacggcgcgtacgccgggtacccgcccgcctaccctccgccgccctcgcaggcggcgggcggattcggtcccgctggctccggctacggcttcgtccccgtcgcgttcccgccggggacgcacccggacgtcgagcgcgccttccgggccgccgaccgcgactgcagcggcgccatcgacgagcgcgagctgcagggagcgctctcctccgcctaccaccgcttcagcgtccgcaccgttcgcctcctcatgttcctcttcaacgacccctcctcctccacgccgtcacggatggggccaacacagttcgtatccctctgggattgccttgagcaatggcgggggaatttttgacaagtaccacaggggaacggaaacgggaaaaatcagccc

SEQ ID NO: 37232 - protein, 161 aa, Zea mays
  misc_feature: Ceres CLONE 1422595-F
  misc_feature (87)..(115): Pfam Name: efhand Pfam Description: EF hand
MSDYNRYGHSYSYGGGYGQGPAPSAPPAPHMPTATSAAPPSSSSYGAYAGYPPAYPPPPSQAAGGFGPAGSGYGFVPVAFPPGTHPDVERAFRAADRDCSGAIDERELQGALSSAYHRFSVRTVRLLMFLFNDPSSSTPSRMGPTQFVSLWDCLEQWRGNF

SEQ ID NO: 37233 - DNA, 642 bp, Zea mays
  misc_feature: Ceres CLONE 1422606-F
  misc_feature: Translation starting site: 534
  misc_feature: SWISSPROT Homolog: EC 2.3.1.144 Anthranilate N-benzoyltransferase
  misc_feature (344)..(344): n is a, c, t, g, unknown, or other
  misc_feature (362)..(362): n is a, c, t, g, unknown, or other
tggagctccccgcggtggcggccgctctagaactagtggatcccccgggctgcaggaattcgcacgagaccattacctagaacttcctaatcgaaaaacctagctcaccgctcactcacaagcacgctgcgaaacacagacgcagagacccgcgcacagatcgaagcggaggatgaaggtggaggtggtggagacgacgctggtgccgccgagcgaggcgacgccgcggcacgcgctgtggctgtccaacctggacctggcggtgcccaaaacccacaccccgctcgtctactactacccgaggcccgccgcgcccggccgcccggggaaggaggggaaagggnaagagggagaagggtcgnttcttcgacccggcgacgcctgcggggaggcgctgtccaggggcgctggtgccctttctacccgcttggcggggcggctgtgcggccggcccgggcggccggctcgagatcgactgcaccggcgagggcgcgctgttctgcgtctcgcgggccgacttcaccggcgacgagatgttcgccgacttcgagccctcccccgaggcgcgccgcctgctcgtgccattcgccgcgtccggcgacccgccctgcgtgctcgccatggtccaggtgaccttcctca

SEQ ID NO: 37234 - DNA, 548 bp, Zea mays
  misc_feature: Ceres CLONE 1422610-F
  misc_feature: Encodes the peptide sequence at SEQ ID NO. 37235
  misc_feature (378)..(378): n is a, c, t, g, unknown, or other
  misc_feature (398)..(398): n is a, c, t, g, unknown, or other
  misc_feature (401)..(401): n is a, c, t, g, unknown, or other
  misc_feature (404)..(404): n is a, c, t, g, unknown, or other
  misc_feature (412)..(412): n is a, c, t, g, unknown, or other
  misc_feature (436)..(436): n is a, c, t, g, unknown, or other
  misc_feature (457)..(457): n is a, c, t, g, unknown, or other
  misc_feature (480)..(480): n is a, c, t, g, unknown, or other
  misc_feature (501)..(501): n is a, c, t, g, unknown, or other
  misc_feature (502)..(502): n is a, c, t, g, unknown, or other
aaagctggagctccccgcggtggcggccgctctagaactagtggatcccccgggctgcaggaattcgcacgagaccattacctagaacatcctaatcgaaaaagaagcatcacacactaatcaacaagcaggaccagctagctagctcctcccactgctatcacccgggccccggccagccatctcgctaagaaaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaggcagccaaaccagcgagagcaacaacagtgctgcgacngcgtgaggaccctgtacgcngcngcngaacacangcccgacatgcaggccacgtgccngtgcctccaggcggcctacgntcaggtccacgctgtgctctccngcgcgcaggaactgccccggnnaactgcggctctcccttgtcttacaacatcaccccccgacatcgac

SEQ ID NO: 37235 - protein, 114 aa, Zea mays
  misc_feature: Ceres CLONE 1422610-F
  misc_feature (58)..(58): Xaa is any aa, unknown, or other
  misc_feature (69)..(69): Xaa is any aa, unknown, or other
  misc_feature (77)..(77): Xaa is any aa, unknown, or other
  misc_feature (84)..(84): Xaa is any aa, unknown, or other
  misc_feature (92)..(92): Xaa is any aa, unknown, or other
  misc_feature (99)..(99): Xaa is any aa, unknown, or other
MKTTSSGIAVVLLVAMLAVQSAVADISCSDVLNDLSPCLPFLQGRQPNQREQQQCCDXVRTLYAAAEHXPDMQATCXCLQAAYXQVHAVLSXAQELPRXTAALPCLTTSPPDID

SEQ ID NO: 37236 - DNA, 667 bp, Zea mays
  misc_feature: Ceres CLONE 1422611-F
  misc_feature: Translation starting site: 201
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (144)..(144): n is a, c, t, g, unknown, or other
  misc_feature (322)..(322): n is a, c, t, g, unknown, or other
  misc_feature (323)..(323): n is a, c, t, g, unknown, or other
  misc_feature (333)..(333): n is a, c, t, g, unknown, or other
  misc_feature (343)..(343): n is a, c, t, g, unknown, or other
  misc_feature (390)..(390): n is a, c, t, g, unknown, or other
  misc_feature (392)..(392): n is a, c, t, g, unknown, or other
  misc_feature (395)..(395): n is a, c, t, g, unknown, or other
  misc_feature (421)..(421): n is a, c, t, g, unknown, or other
  misc_feature (594)..(594): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggggctccccgcggtggcggccgctctagaactagtggatccccncgggctgcaggaattcgcacgagaccattacctagaacatcctaatcgaaaataccatgatgaagtttgcttcctttgagaccatcgttgagcttatctacaagcatgctgtgcctgttccgaagtctgagtgcagcaagactacccagttgggtattagcttttgctgggtgttacnngtgcggtgtnctctgtgctnatggttctcacccggctgacaaccttgtgtctttcctgaacatggcnanggnagctacagtggggagatgctggttangaagctgggtctcctgggggctccttccctaaaggaccttccccctcccaatcggcatggatggggaccccttacctgggccccaaggggggaatttttccaaagccttccaaagggagtgggttgggactcccaacaacccgggggggggtttaaacctgggccccccaagnaaaaagggtttaaaatttaaaacccccggggcctgaaattttttttctccggggggtccccccggaaaaaaaa

SEQ ID NO: 37237 - DNA, 560 bp, Zea mays
  misc_feature: Ceres CLONE 1422612-F
  misc_feature: Encodes the peptide sequence at SEQ ID NO. 37238
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (331)..(331): n is a, c, t, g, unknown, or other
  misc_feature (332)..(332): n is a, c, t, g, unknown, or other
  misc_feature (339)..(339): n is a, c, t, g, unknown, or other
  misc_feature (341)..(341): n is a, c, t, g, unknown, or other
  misc_feature (342)..(342): n is a, c, t, g, unknown, or other
  misc_feature (365)..(365): n is a, c, t, g, unknown, or other
  misc_feature (366)..(366): n is a, c, t, g, unknown, or other
  misc_feature (413)..(413): n is a, c, t, g, unknown, or other
  misc_feature (469)..(469): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactgggactccaccgcggtggcggccgctctagaatagtggatccccgggctgcaggaattcgcacgagaccattacctagaacatcctaatcgaaaaagctaagggaagggaaacaagaccatggatgcctccaagctccgcgagcttcgcgacttcgtcgaggcgtgcaagaagaatccttcgctcctcgccgacccaaaactctctttcttcggnnattactncnnagagttgggtgccaaattcccgnncgcgccccctctttcgaaagtcccaagagatctttccatggacaacnttgatgacgacggtgatgacaaccaccattttggattgaggaatcccactctgagncaaacgaactcaataaaaaaattggttaatctcgacctttaacccagaaggaaaaattgttcagtcttaacccttgttgccccccccccca

SEQ ID NO: 37238 - protein, 91 aa, Zea mays
  misc_feature: Ceres CLONE 1422612-F
  misc_feature (33)..(33): Xaa is any aa, unknown, or other
  misc_feature (35)..(35): Xaa is any aa, unknown, or other
  misc_feature (36)..(36): Xaa is any aa, unknown, or other
  misc_feature (44)..(44): Xaa is any aa, unknown, or other
  misc_feature (60)..(60): Xaa is any aa, unknown, or other
  misc_feature (78)..(78): Xaa is any aa, unknown, or other
MDASKLRELRDFVEACKKNPSLLADPKLSFFGXYXXELGAKFPXAPPLSKVPRDLSMDNXDDDGDDNHHFGLRNPTLXQTNSIKKLVNLDL

SEQ ID NO: 37239 - DNA, 620 bp, Zea mays
  misc_feature: Ceres CLONE 1422613-F
  misc_feature: Encodes the peptide sequence at SEQ ID NO. 37240
  misc_feature (282)..(282): n is a, c, t, g, unknown, or other
  misc_feature (426)..(426): n is a, c, t, g, unknown, or other
  misc_feature (497)..(497): n is a, c, t, g, unknown, or other
  misc_feature (508)..(508): n is a, c, t, g, unknown, or other
aagctggagctccccgcggtggcggccgctctagaactagtggatcccccgggctgcaggaattcgcacgagaccattacctagaacatcctaatcgaaaaacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcaggggccgggacagcatcngcggcggtgagctgcggcgaggtgacgtcatctgtggcgccatgcctcgggtacacgatgggcagcgcggcgtcgccctccgcagcgtgctgcaacggggtgcgctcgctcaacagccgcgcgtcgtcgacggctgaccggcangccaccatgcactgcatcaagagcatgacgggcccgactcagcagcggcgtcagcatggccaaacgcgccnacatcccctcnaagtgcggacgtctcgtcggcgtgcccatcagcaccaccgtcgactgcaccaagaatcactgatcgatggaaccatagtggaagtagctcgctcggtggatggcaccctact

SEQ ID NO: 37240 - protein, 146 aa, Zea mays
  misc_feature: Ceres CLONE 1422613-F
  misc_feature (39)..(145): Pfam Name: Tryp_alpha_amyl Pfam Description: Protease inhibitor/seed storage/LTP family
  misc_feature (82)..(82): Xaa is any aa, unknown, or other
  misc_feature (106)..(106): Xaa is any aa, unknown, or other
  misc_feature (110)..(110): Xaa is any aa, unknown, or other
MAARSSSSQPQLVAAAAVLAAALLLLAAGAGTASAAVSCGEVTSSVAPCLGYTMGSAASPSAACCNGVRSLNSRASSTADRXATMHCIKSMTGPTQQRRQHGQTRXHPLXVRTSRRRAHQHHRRLHQESLIDGTIVEVARSVDGTL

SEQ ID NO: 37241 - DNA, 573 bp, Zea mays
  misc_feature: Ceres CLONE 1422622-F
  misc_feature: Encodes the peptide sequence at SEQ ID NO. 37242
  misc_feature (292)..(292): n is a, c, t, g, unknown, or other
aagctggagctccccgcggtggcggccgctctagaactagtggatcccccgggctgcaggaattcgcacgagaccattacctagaacatcctaatcgaaaactcaaagttcggagtcgaggccgccgcccagaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctngccttctttctcaccttatgaaagggagattgccacgaggaactacatgacccagagccttggggccctttcatgtctggtagcgtggcatcaatgttccagtgatgccgactccgctttttgccaatgcctccgccgagaaaagtggcaaaaaactcatgatggatttcatgatggggcggtgtttcagctgctgtttccaaaactgcacctgctcccattgaccaatggagctgcctattccaaatccggatggaattatcaagtcctgggaaggcatc

SEQ ID NO: 37242 - protein, 127 aa, Zea mays
  misc_feature: Ceres CLONE 1422622-F
  misc_feature (34)..(34): Xaa is any aa, unknown, or other
MADQANQPTVLHKLGGQFHLSSSFSEGVRARNIXPSFSPYEREIATRNYMTQSLGALSCLVAWHQCSSDADSAFCQCLRREKWQKTHDGFHDGAVFQLLFPKLHLLPLTNGAAYSKSGWNYQVLGRH

SEQ ID NO: 37243 - DNA, 677 bp, Zea mays
  misc_feature: Ceres CLONE 1422625-F
  misc_feature: Encodes the peptide sequence at SEQ ID NO. 37244
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (335)..(335): n is a, c, t, g, unknown, or other
  misc_feature (420)..(420): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgccctcagtancagcggcggctgtggctgccagacacccacgtttcatctaccgcctcccgtctatatgccgcctccgttctatctgcccgcgcancagcagccgcagccatgggaatacccacctcaccaccggagctaaacccgttgcaaccatttcggatcctggggggtcgggaatttcgggagaccgttcctgggccaatgcgtcaatttcctaagggaccattgaaacccgggggggaaaccccctagggttcccccaatgggccaggggtttgaaacaaaaagggtgtcgcccccaaaaaaaggagggggggacccccctttcccccgttacccagggggaaataa

SEQ ID NO: 37244 - protein, 63 aa, Zea mays
  misc_feature: Ceres CLONE 1422625-F
  misc_feature (21)..(21): Xaa is any aa, unknown, or other
  misc_feature (49)..(49): Xaa is any aa, unknown, or other
MKVLIVALALLALAASAALSXSGGCGCQTPTFHLPPPVYMPPPFYLPAXQQPQPWEYPPHHRS

SEQ ID NO: 37245 - DNA, 647 bp, Zea mays
  misc_feature: Ceres CLONE 1422626-F
  misc_feature: Encodes the peptide sequence at SEQ ID NO. 37246
ggagctccccgcggtggcggccgctctagaactagtggatcccccgggctgcaggaattcgcacgagaccattacctagaacatcctaatcgaaaacttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgataaacatcctcttccaaatcgtagtctagcccgtgcccaaaaccctagcgaccgccggagagctcgtccgaatcgaggccaccgaggggaaattagatcgcggcggacgatggagagccctgcgaaagaggaggccgggggagagctggcaatggagatcgagtcgtcggtcacggcggaggactggcgccgcgcgctttctcgcgtcgtgccgtccgtcgtcgtcctccgcacactgcgccgcgcgcctttgacacgaagtcgcgggcgccagctacgccacgggtttcgtcggtgacaagtcccgcggaataatcctcactaacccccatggtcgtcagccaaggactggtggtccccggaggccatgttccatgaaccagggaagaaaatcccc

SEQ ID NO: 37246 - protein, 62 aa, Zea mays
  misc_feature: Ceres CLONE 1422626-F
MESPAKEEAGGELAMEIESSVTAEDWRRALSRVVPSVVVLRTLRRAPLTRSRGRQLRHGFRR

SEQ ID NO: 37247 - DNA, 591 bp, Zea mays
  misc_feature: Ceres CLONE 1422632-F
  misc_feature: Encodes the peptide sequence at SEQ ID NO. 37248
  misc_feature (349)..(349): n is a, c, t, g, unknown, or other
  misc_feature (367)..(367): n is a, c, t, g, unknown, or other
  misc_feature (437)..(437): n is a, c, t, g, unknown, or other
  misc_feature (443)..(443): n is a, c, t, g, unknown, or other
  misc_feature (444)..(444): n is a, c, t, g, unknown, or other
  misc_feature (491)..(491): n is a, c, t, g, unknown, or other
  misc_feature (511)..(511): n is a, c, t, g, unknown, or other
  misc_feature (514)..(514): n is a, c, t, g, unknown, or other
  misc_feature (535)..(535): n is a, c, t, g, unknown, or other
ggagctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctgnacccgcctctgcttgcangctgcgccaagatcgtcccaggcatacgacaacgcgccggaaagaccggagagaataggggaccagtacnaggacnncggcgaagaagcgaaagacgccaccggggacgcccaggagcacgccnagaagatggccggggagacnaanaagcaagccgcaagacaaggncccgccgcggtgcgggacccagcgttcgggcatgggccgagcggggcaaggaacag

SEQ ID NO: 37248 - protein, 129 aa, Zea mays
  misc_feature: Ceres CLONE 1422632-F
  misc_feature (49)..(49): Xaa is any aa, unknown, or other
  misc_feature (55)..(55): Xaa is any aa, unknown, or other
  misc_feature (79)..(79): Xaa is any aa, unknown, or other
  misc_feature (81)..(81): Xaa is any aa, unknown, or other
  misc_feature (97)..(97): Xaa is any aa, unknown, or other
  misc_feature (104)..(104): Xaa is any aa, unknown, or other
MSRLMAAMLLGGARVAGAAKLTGNGNAAGMQALPMPACFLPPRPQAATXTRLCLXAAPRSSQAYDNAPERPERIGDQYXDXGEEAKDATGDAQEHAXKMAGETXKQAARQGPAAVRDPAFGHGPSGARN

SEQ ID NO: 37249 - DNA, 681 bp, Zea mays
  misc_feature: Ceres CLONE 1422635-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (352)..(352): n is a, c, t, g, unknown, or other
  misc_feature (367)..(367): n is a, c, t, g, unknown, or other
  misc_feature (370)..(370): n is a, c, t, g, unknown, or other
  misc_feature (394)..(394): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactggaactccacgcggtggcggccgctctagaatagtggatcccccgggctgcaggaattcgcacgagaccattacctagaacatcctaatcgaaaaagctagctacatccactgatccacgcgcattccccgtaacaccgccaccgcgccgcgtcacggaaggaagaagatgtcgtcgtctcccctcgcggcggcccaccgnctggatctggatggnaancccatcgctccccctcacatctgnatgatcggcgcccggcggtttcatcggcttccaccctctgcaaaaaactaatgggcgagaaccacccaaaccgtcctcgcctgttgaacctcttacggggaacaaaaaccccccaacttttggaaaccccggggccgcgaaaacttgggggggggaattttatttcccccccccttaaaaaaaaaaaaaaaaatccccgggctaaaagggggcctctcaaaaaggggggcaaatttgccacaaaaaacgggggccgcaaatatttgaacccccgcgggaaaaaaaaa

SEQ ID NO: 37250 - DNA, 653 bp, Zea mays
  misc_feature: Ceres CLONE 1422653-F
  misc_feature: Translation starting site: 182
  misc_feature: Pfam Name: CSD Pfam Description: 'Cold-shock' DNA-binding domain
caaagctggagctccccgcggtggcggccgctctagaactagtggatcccccgggctgcaggaattcgcacgagaccattacctagaacatcctaatcgaaaagatcgagcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcgggcccgctggggtgcgccccagccgagctggcgctgcggggcagccgcgacggggagtgcgacgcctagctgcagcgcgccgccgcgctctacaacccgcagctgggtgacatgatccaaggcgtcaacgcggaagctcgggggccgaagtccttcttccccgtccaacgcctaccgaaggccatgggatttattttccaacccggggggcttaaggtttcc

SEQ ID NO: 37251 - DNA, 605 bp, Zea mays
  misc_feature: Ceres CLONE 1422656-F
  misc_feature: Encodes the peptide sequence at SEQ ID NO. 37252
  misc_feature (162)..(162): n is a, c, t, g, unknown, or other
  misc_feature (265)..(265): n is a, c, t, g, unknown, or other
  misc_feature (307)..(307): n is a, c, t, g, unknown, or other
aaagctggagctccccgcggtggcggccgctctagaactagtggatcccccgggctgcaggattcgcacgagaccattacctagaacatcctaatcgaaaaatcacgaacaccgttctccatagcgggagtagtgaggaaggaaagagagggggcggcctanggcttcgattccgcagccatggacgccgctgacgtgtggggccgctcgtcgtcctcgtcttcttcgtccgccgccgccgcgaggcgcctgcaggcgcgctacnatctgtacatggggatcaacaaccccgaaccccgccttgacnaagtgaccgaacccccccgcgggggcggattcctaaaattgccccttttggggggaggaacttggactttctcggggccttggtttttcacttaaaaaaaaaaatgtgccttttaggctaaaaaggggggcttgccccccctttggtttccaggggtcggaaaagggcttgttatggaccttttttcttttcacccagggggattttttttccaaatgaccccccgggcccccaataccccaaaaaaaatttttcttgggggcccccctttttttttttttcttttttgaaaaaaaga

SEQ ID NO: 37252 - protein, 73 aa, Zea mays
  misc_feature: Ceres CLONE 1422656-F
  misc_feature (29)..(29): Xaa is any aa, unknown, or other
  misc_feature (43)..(43): Xaa is any aa, unknown, or other
MDAADVWGRSSSSSSSSAAAARRLQARYXLYMGINNPEPRLDXVTEPPRGGGFLKLPLLGGGTWTFSGPWFFT

SEQ ID NO: 37253 - DNA, 661 bp, Zea mays
  misc_feature: Ceres CLONE 1422659-F
  misc_feature: Encodes the peptide sequence at SEQ ID NO. 37254
ccccgcggtggcggccgctctttaatagtggatcccccgggctgcaggtattcgcacgagaccattacctagaacatcctaatcgaaaaatcaatcacaggctcaccatacctaccaacaagcaaaaattccccaatcctctcgtctccgcggtgaaaatgtcggggctcagtcagggcggcaagggcctgagcaaggtcggggcgaaccgtcaccggaaggtgctgcacgacaacagtccatgggatcacgaagccggctatacggaggttggcgcggcggggcggcgtgaaacgcatgtcggggatcatctacgaggagacccccggtgtgctcaagatcttcctggagaacgtcatacgcgacaccctcacctacgacgaggaagcgcgccctatgacccccaccgccgtggacgtcagctactatcttaaaggccagggacgaaccctctacggcttctgcagctaggactgctagcgccgcgattcgacaacactgcggttctggtgtcgatgaagttcacacgttgtttgagtggaaggaaaaatgctatatactgaagaactgcaatcgctgatgtgcacatgcagatgatgaccgaagaaatcgtgccaatgatggcttgctctggactcaagaacaacaaaagaaaagctta

SEQ ID NO: 37254 - protein, 57 aa, Zea mays
  misc_feature: Ceres CLONE 1422659-F
MSGIIYEETPGVLKIFLENVIRDTLTYDEEARPMTPTAVDVSYYLKGQGRTLYGFCS

SEQ ID NO: 37255 - DNA, 687 bp, Zea mays
  misc_feature: Ceres CLONE 1422670-F
  misc_feature: Encodes the peptide sequence at SEQ ID NO. 37256
  misc_feature (687)..(687): n is a, c, t, g, unknown, or other
aaagctggagctcaccgcggtggcggccgctctagaatagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccagtactactgcacggtcattgatgcccctggacaccgtgactttcataagaaaatgatcaccgggtacctccccggctgactggggcgggccttatacttgaatcccccccggggggttttggagggggggatcccccaaggaaggggcaaacccgtgaaaaaggcccctcctttgggttccccccttggaagggaaacaaaataattttgcttggcggccaccaaaatggggaggaaccccccccccaaatacccccagn

SEQ ID NO: 37256 - protein, 101 aa, Zea mays
  misc_feature: Ceres CLONE 1422670-F
  misc_feature (5)..(101): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTSTTARSLMPLDTVTFIRK

SEQ ID NO: 37257 - DNA, 674 bp, Zea mays
  misc_feature: Ceres CLONE 1422673-F
  misc_feature: Encodes the peptide sequence at SEQ ID NO. 37258
acaaagctggagctccccgcggtggcggccgctctagaactagtggatcccccgggctgcaggaattcgcacgagaccattacctagaacatcctaatcgaaaaagaaagcagagagagccggcaacatcgcagagagagagagagagagagagaggcaaactggagaggccgagggtgatggtttccaaggagcagaataagcgaggagctttgcatgagaagctcaagattctccgcagcgttactcactctcatgcgatcagtcatgctgtgtgtgctctgctatatatctacgtaccaataccattcagcttttcagaccattcctatgctgtcaagttatatgcaacacgcgtacgtgtgtgtgtgtcacgcatgcagggggataaagtgtcgataatagcggacgcgtcatcgtacatcaaggaactaaagcagaagatcgcgaagctaagccaagagatggcatcgtcgtctccgcagcacgccactagtgtctgccaacaacaaccgtcgtcgtcgtcggtgagtgtgggagtcctgctggacaagaagggccgtttcctcgtcagtgtgttcatggacgagagctgcggcccgccgccggccgggctactcgcttccgtcctcgaggccttcgacgagatcggactcacggtgcttgaggctagg

SEQ ID NO: 37258 - protein, 165 aa, Zea mays
  misc_feature: Ceres CLONE 1422673-F
MVSKEQNKRGALHEKLKILRSVTHSHAISHAVCALLYIYVPIPFSFSDHSYAVKLYATRVRVCVSRMQGDKVSIIADASSYIKELKQKIAKLSQEMASSSPQHATSVCQQQPSSSSVSVGVLLDKKGRFLVSVFMDESCGPPPAGLLASVLEAFDEIGLTVLEAR

SEQ ID NO: 37259 - DNA, 608 bp, Zea mays
  misc_feature: Ceres CLONE 1422682-F
  misc_feature: Encodes the peptide sequence at SEQ ID NO. 37260
  misc_feature (375)..(375): n is a, c, t, g, unknown, or other
  misc_feature (382)..(382): n is a, c, t, g, unknown, or other
  misc_feature (396)..(396): n is a, c, t, g, unknown, or other
  misc_feature (417)..(417): n is a, c, t, g, unknown, or other
  misc_feature (438)..(438): n is a, c, t, g, unknown, or other
  misc_feature (451)..(451): n is a, c, t, g, unknown, or other
  misc_feature (548)..(548): n is a, c, t, g, unknown, or other
aaagctggagctccaccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctcccaacagcaatcgcagcaagcaacataccntttatcnacccttggttgttncaaacatcgcccagccctacntcttggtgcagtcattggtancaaaccatcaggncacagcagctgcagcaactcgtgctacctgtgatcaaccaagtagctctggcaaaacttttctcctactctcagcaacacaatttcttccattcaancaactgtctacactgacccttgctgcttatttgcagcaacactattaccattccagccgc

SEQ ID NO: 37260 - protein, 130 aa, Zea mays
  misc_feature: Ceres CLONE 1422682-F
  misc_feature (71)..(71): Xaa is any aa, unknown, or other
  misc_feature (75)..(75): Xaa is any aa, unknown, or other
  misc_feature (89)..(89): Xaa is any aa, unknown, or other
  misc_feature (94)..(94): Xaa is any aa, unknown, or other
  misc_feature (126)..(126): Xaa is any aa, unknown, or other
MATKIFSLLMLLALSACVANATIFPQCSQAPIASLLPPYLPSMIASVCENPALQPYRLPTAIAASNIPFIXPWLXQTSPSPTSWCSHWXQTIRXQQLQQLVLPVINQVALAKLFSYSQQHNFFHSXNCLH

SEQ ID NO: 37261 - DNA, 656 bp, Zea mays
  misc_feature: Ceres CLONE 1422687-F
  misc_feature (179)..(179): n is a, c, t, g, unknown, or other
  misc_feature (288)..(288): n is a, c, t, g, unknown, or other
aaagctggagctccccgcggtggcggccgctctagaactagtggatcccccgggctgcaggaattcgcacgagaccattacctagaacatcctaatcgaaaaataaaaaaaaatccgtcttcttgtggtcttctccaaaccctagcgcccccggccccggtctccgcccccccgccttncgcgtcgcggtcgcgccccatggcggggaagtcgcgaccgccccagcggatcctccagtcctatacccatcaggggtccggacagagtcatcaagcctggcggattggntgcttatgaggggcatttgatgcttcaaagccccctttgtgggcaaagtttgaggcaattgaaacccccggatcttctgggcccccctttttaaaacacaagggccggggttttttttccccccaggaaggcccccaggggggcggggcgccttttttggtttctcaaaagggttttcccctttccccccctctttgtttaacaaggcgtgcccccccttttgggggggaaaaaaaaagtttcccccccttccccgaaatttataaaaatttgttttttccccccgcgggggagaatttttctcccccccccccgaaaaaaaaaaacaccccgggggggggtttttttccacacccaaagaaaagagg

SEQ ID NO: 37262 - DNA, 718 bp, Zea mays
  misc_feature: Ceres CLONE 1422690-F
  misc_feature: Translation starting site: 304
  misc_feature: SWISSPROT Homolog: EC 3.2.1.39 Glucan endo-1,3-beta-D-glucosidase
  misc_feature (589)..(589): n is a, c, t, g, unknown, or other
ggagctccccgcggtggcggccgctctagaactagtggatcccccgggctgcaggaattcgcacgagaccattaccagaacatcctaatcgaaaaaccatttcgctagctccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgcgacatgggcttccccctccggcggatgcatgtggcgatcgactacacctgcgccaagggggccgactgcgcctccgcctccaagggcgcgccctgctacggcaacggcaacaaggtggccgtctgctcctacatctgcaacagctactaccagagccgcagcgccacgggcgccacctgcgacttcaacggcgtcgccacgctcaccggcaccgaccccagctccggcacctgcaagttcgcctccggccccagcagcgcaggcaccggcggtggcatgggcgctggcngcggtaccggcggtggcatgggcgctggcaccggcgccgggacaggcgttggcaccggagcaggcacgggcatgggcaccgggacgggtaccagcaccggcaccggcgccggcgcaggggtcgcgaccc

SEQ ID NO: 37263 - DNA, 714 bp, Zea mays
  misc_feature: Ceres CLONE 1422691-F
  misc_feature: Encodes the peptide sequence at SEQ ID NO. 37264
  misc_feature (507)..(507): n is a, c, t, g, unknown, or other
aagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttccctgtgtcactggggagtgcanggagtgtgcccactgcaagtcggcagagagcaacatgtgtgatctgctcaggatcaacaccgaccgcggtgtgatgattgccgatggcaagtcgcggtttttcatcaatgggaggccttctccacctttgttggacctccacctccgcgagtccccctcatgcatgtgggttggttgcaaagatcaccctcagctcccctgataagt

SEQ ID NO: 37264 - protein, 166 aa, Zea mays
  misc_feature: Ceres CLONE 1422691-F
  misc_feature (34)..(135): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (100)..(100): Xaa is any aa, unknown, or other
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPCVTGECXECAHCKSAESNMCDLLRINTDRGVMIADGKSRFFINGRPSPPLLDLHLRESPSCMWVGCKDHPQLP

SEQ ID NO: 37265 - DNA, 710 bp, Zea mays
  misc_feature: Ceres CLONE 1422700-F
  misc_feature: Translation starting site: 180
  misc_feature: SWISSPROT Homolog: EC 1.1.1.184 Carbonyl reductase (NADPH)
ctccccgcggtggcggccgctctagaactagtggatcccccgggctgcaggaattcgcacgagaccattacctagaacatcctaatcgaaaaaaattctattactagctgcaaaagggcgtgtttgagactagcggaccgaccttgaagttgaagttgaaaaggccggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgccacgtctccgacgcacagcagcgcaagagcctcatcgagacggccgtcaagagctttgggcacatagatattcttgtctccaatgctgccgcaatccttctgtagatagcatacttgaaatgaaagagtctgttctcgataagttgtgggatattaacgtcaaggcttctatccttcttacccaggatgctgctcctcactacggaaggggccacctgggatattaatttctcaattgcctggtaacatccaaaacaaggattgaaattttatgggggcccaaaaactgcctcctttgggccccacaagggcctttggtggggagaggggacc

SEQ ID NO: 37266 - DNA, 741 bp, Zea mays
  misc_feature: Ceres CLONE 1422702-F
  misc_feature: Translation starting site: 259
  misc_feature: SWISSPROT Homolog: EC 3.4.25.1 Proteasome endopeptidase complex
  misc_feature (672)..(672): n is a, c, t, g, unknown, or other
  misc_feature (676)..(676): n is a, c, t, g, unknown, or other
  misc_feature (719)..(719): n is a, c, t, g, unknown, or other
aaagctggagctccccgcggtggcggccgctctagaactagtggatcccccgggctgcaggaattcgcacgagaccattacctagaacatcctaatcgaaaagccgccgttaaaccctaccgctgctctcgtcaccatctctccgactcacccctctgtcctcgcaagccgccgccggccaagtcctgtccctctcccttgtctggttcggatcgtcgttgctagccaggtgctggatccgtagcggcggcggcggccatggacaagagcatgctcggcgacctggacggcctccccgagaacgacaatccgcggattggcaccaagataacacccaatctccataactccaggtccgtgcgcaagatcgcgtgcctgggcacacacatcgctcaggcatccgcggggctgaaggcggaaccacgccttgcttcatcaaccgcgcgccgggtcgagtgccagagccaccgactcaaccggtcgaagggaccccgtcacccgtcaaggtacatccacccgctaccatcgcctgggcctgcagcagaagtatacacagaagtgggtggaattccgccccttttcggcctctccacactccattgtcggtttcgacccctacaccgacaacccagcgctgtaccagaccgatccttctggtaccttctctgcttngaangcgaacgccacgggaaggaactccaactctatgcgtgagtttnctgagaagactacaatgagacc

SEQ ID NO: 37267 - DNA, 640 bp, Zea mays
  misc_feature: Ceres CLONE 1422703-F
  misc_feature: Encodes the peptide sequence at SEQ ID NO. 37268
aaagctggactccccgcggtggcggccgctctagaactagtggatcccccgggctgcaggaattcgcacgagaccattacctagaacatcctaatcgaaaataaaccctacccgactccgccgccgcccgccgctccgcctcagcgcatagcccgccgcgacctcatcgatcaccttcaactttcaatcatggcggacgtcgatgtcgaacggaggttgccgccggagctccaagaagagacgttccgcagtacagctaccgcggcgtcgactagatgcgcttctcgacatgtccacggacgaccctcgtcagctcttccccgcgcgcgccaggagagggtccagaggggtctgaagaaggagcccatgccgctcattcagaagctgcccaagcgaaaaagatgctcctgctggtaaaaacccgaccagtcaaaacccttcccgaacatgaacattgcccctgaaaagaatggaagctttgttggggtctacaacggaaaaccctcaaccgggtagaaaccaaccgggaatgtcccgcccccaccctggggaaggtcccccctcccaaaaaaccgcgcaaaatgggggggccccgttttttggcccccccccccccccggggtttttccctcgaaaagga

SEQ ID NO: 37268 - protein, 75 aa, Zea mays
  misc_feature: Ceres CLONE 1422703-F
MADVDVERRLPPELQEETFRSTATAASTRCASRHVHGRPSSALPRARQERVQRGLKKEPMPLIQKLPKRKRCSCW

SEQ ID NO: 37269 - DNA, 729 bp, Zea mays
  misc_feature: Ceres CLONE 1422705-F
  misc_feature: Encodes the peptide sequence at SEQ ID NO. 37270
atagcagaagctccccgcgctggcggccgctctacaactagtgcatcccccgggctgcaggaattcgcactagaccattacctagaacatcctaatcgaaaaatactcctccggatccgtgttccatcaaggctacaaaaatactccgcctgcatctccaaagcacacggctccctctggtttcccgcctcctcttcacctccttagcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctggaagctccagttgttgttgttacaggtgcctctagagggattggaaaggcaactgctctagcccttggaaaagcaggatgcaaggttctggtaaattatgctcggtcttcgaaagaggctgaagaggtctccaaagagattgaagcatctggtggtgaggctatcacctttggaggagatgtttcaaaagaagctgatgtagagtctatgatgaaagcagctctagataaatggggaacgatagatgtgctggtaaataatgcaggaattacacgagacacattattgatgaaga

SEQ ID NO: 37270 - protein, 168 aa, Zea mays
  misc_feature: Ceres CLONE 1422705-F
  misc_feature (73)..(168): Pfam Name: adh_short Pfam Description: short chain dehydrogenase
  misc_feature: SWISSPROT Homolog: EC 1.1.1.100 3-oxoacyl-[acyl-carrier-protein] reductase
MAAAAAAAAAVSSPIAPRAVAAAASRRGFVTFGGGAARSSPTLRSGRGFSGVQTHVAAVEQAVVKDATKLEAPVVVVTGASRGIGKATALALGKAGCKVLVNYARSSKEAEEVSKEIEASGGEAITFGGDVSKEADVESMMKAALDKWGTIDVLVNNAGITRDTLLMK

SEQ ID NO: 37271 - DNA, 728 bp, Zea mays
  misc_feature: Ceres CLONE 1422707-F
  misc_feature: Encodes the peptide sequence at SEQ ID NO. 37272
tccccgcggtggcggccgctctattactagtggatcccccgggctgcaggatttcgcacgagaccattacctagaacatcctaatcgaaaaacaaggtgttcttaaaaaaagtaaatttgccgtctgcaaaagccctcccacagccgtggccgcgcgccagtccgccagcgagagaagtccgcttcatccgttcgccgcctcaaagacgagatggatacatgatgacctgcagcacttgccaatgcaaagatgcagaatatgtttgctgggcaaagagtgcgcaaggatgttcaagtccaacacaatgaaggtggagtgcttgtcgggcacttcaccgatgggcaccatctgtgtgccaaaagcgccatggacgatccccgtatcacattctatggacgtataaggaactgctgaaaacagccagaccatccgtgctgaagattgcacataatgtggtgcccttctttgatgataagggttttgatgagttgtgataactggtccagtggaggatcaatcacctcttcctgtagagatcaccatcccccggacgatcttcaaacaacatgagcttgtgttaaactggatgtctccgctttagatttgagacttggctacatggttctttcattgcatggaggacctgggagacccctgttaactggaaagtataggacttcgataatcctgtctaagcagcgtaggacttcaaaagcaggtccaaatt

SEQ ID NO: 37272 - protein, 54 aa, Zea mays
  misc_feature: Ceres CLONE 1422707-F
MQNMFAGQRVRKDVQVQHNEGGVLVGHFTDGHHLCAKSAMDDPRITFYGRIRNC

SEQ ID NO: 37273 - DNA, 763 bp, Zea mays
  misc_feature: Ceres CLONE 1422715-F
  misc_feature: Encodes the peptide sequence at SEQ ID NO. 37274
  misc_feature (763)..(763): n is a, c, t, g, unknown, or other
atagctggagctccccgcggtggcggccgctctagaactagtggatcccccgggctgcaggaattcgcacgagaccattacctagaacatcctaatcgaaaagaaagtttcgaacaaaagtccacaaatccccttcgccgtctccggcgagccccacccctcatcgccgccgggccaaagagacagtgagaggggggatggatcagtccatcagagccgcatgcgagttcctctcgtcggtgctaaaccacgctgagtcctcgtcccgcgagctcgccgacgccgtctcccaacgccccgtccacctcgagatggcgaggacctcgttcctgcagaagctggagcacagggtggaggcgtcggccgccgacttgcagcacatcgagtccatcgccctcgacaccgtctccttcgaggagctcctcggccactgcggcgagacgctcaaagtctacgcgcgccacgcctacgccctcgaatcacccctcactctgctttcggtcgaagagccgctgctggtggcactcgcacgtgcatcatatcaattcaggccttgtggactatcctcccccgtgggcgggcctgctttaaaaaggtgaatcttgtaccacatggcccgctcacgttcggcatagttctggcggcaccctgccatggtggaaccgcgtactaaccgccctgcccctggggtcgccccccctcgctccacggtggttccctcctagggtcgaacccccgcccccaggcgggtgcgcccccgaan

SEQ ID NO: 37274 - protein, 133 aa, Zea mays
  misc_feature: Ceres CLONE 1422715-F
MDQSIRAACEFLSSVLNHAESSSRELADAVSQRPVHLEMARTSFLQKLEHRVEASAADLQHIESIALDTVSFEELLGHCGETLKVYARHAYALESPLTLLSVEEPLLVALARASYQFRPCGLSSPVGGPALKR

SEQ ID NO: 37275 - DNA, 710 bp, Zea mays
  misc_feature: Ceres CLONE 1422718-F
  misc_feature: Encodes the peptide sequence at SEQ ID NO. 37276
atagctggagctccccgcggtggcggccgctctagaactagtggatcccccgggctgcaggaattcgcacgagaccattacctagaacatcctaatcgaaaaactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgctcatctccctccacctcgccgcggcgcggcggaggcggcccaggaagggcgtcgcgcacgcgccggcgggggcgccgccgctgtccccgtccaccatcccgcccgtgtccaaggagatccaggaggtggccgtccacgtcggctcgcttccgcactaccttggagacgggggcacaccttttctcaaagggaaaggggggaaacgggaaaagggaaaaagtggaattcccttggtggcaaaagggggttcaaaaacccgccccctcacaaaataaacctccccccaaaaaaaaacccccccccctttttttttttttttttttttt

SEQ ID NO: 37276 - protein, 133 aa, Zea mays
  misc_feature: Ceres CLONE 1422718-F
MSPPPPPPLLRNELSRRTAVLGLRLWVLVGIAVGAAFVLLLVLISLHLAAARRRRPRKGVAHAPAGAPPLSPSTIPPVSKEIQEVAVHVGSLPHYLGDGGTPFLKGKGGKREKGKSGIPLVAKGGSKTRPLTK

SEQ ID NO: 37277 - DNA, 740 bp, Zea mays
  misc_feature: Ceres CLONE 1422728-F
  misc_feature: Encodes the peptide sequence at SEQ ID NO. 37278
atagctggagctccccgcggtggcggccgctctagaactagtggatcccccgggctgcaggaattcgcacgagaccattacctagaacatcctaatcgaaaatcatcgatcgccaatgcaagtttgtccattcccattggtctgaatactgcaactactagcgcgagtgccactgtgccgcagctgcctgctcggcattactgcaagctgtgtatcaatcaaagcttaattaggctccctctacatctgatccagctaagtagataaccagcactacagaagggcgtggcaagaatcaggagagagatagcaggggggctagctagctgacctcgtgcgactaagaatggccggaattgacaggaacatggtggccccgctcctggtgctcaacctcatcatgtacatcatcgtcatccgcttcgctagctggaacctgaaccacttcatcaacgggcagaccaactaccccggagaggccggcaacggcgcgacactctacttcctggtgtacgacaccctggccggcatgaagggcactgcgtccaacctggcgggcatgcaccacctgcgcgcctggcaccaagacagtctggccaccaacgccgcgtcgacactcatcccctgggccatcacggcactcgccttccggctgtgctgcaagaagatccacacggcggacacccgcgatggcccctgcccatgcgggaaggcctaataattcatccttcccctactgt

SEQ ID NO: 37278 - protein, 123 aa, Zea mays
  misc_feature: Ceres CLONE 1422728-F
  misc_feature (14)..(122): Pfam Name: AWPM-19 Pfam Description: AWPM-19-like family
MAGIDRNMVAPLLVLNLIMYIIVIRFASWNLNHFINGQTNYPGEAGNGATLYFLVYDTLAGMKGTASNLAGMHHLRAWHQDSLATNAASTLIPWAITALAFRLCCKKIHTADTRDGPCPCGKA

SEQ ID NO: 37279 - DNA, 716 bp, Zea mays
  misc_feature: Ceres CLONE 1422730-F
  misc_feature: Encodes the peptide sequence at SEQ ID NO. 37280
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtaactactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcatggccggcgtggtgggcgcggcgtccaagctagctggcgtgcaccacgtgcgcgcctggcgccacgacagcctggccaccaacgccgcgtcgtcgctcatcggcatgggccatcacgaggctcgccttccggttgggctgcaaagaagaaccacatcggcggaaaaccgcggcttggcccctggcccttcctggaagc

SEQ ID NO: 37280 - protein, 124 aa, Zea mays
  misc_feature: Ceres CLONE 1422730-F
  misc_feature (14)..(117): Pfam Name: AWPM-19 Pfam Description: AWPM-19-like family
MAGIGRNMVAPLLVLNLIMYIIVIGFASWNLNHFINGQTNYPGVAGNGATFYFLVFAIMAGVVGAASKLAGVHHVRAWRHDSLATNAASSLIGMGHHEARLPVGLQRRTTSAENRGLAPGPSWK

SEQ ID NO: 37281 - DNA, 712 bp, Zea mays
  misc_feature: Ceres CLONE 1422732-F
  misc_feature: Translation starting site: 153
  misc_feature (564)..(564): n is a, c, t, g, unknown, or other
  misc_feature (565)..(565): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaactcagctgctggcccgctgcctgcagccattgcccgctcctcgaggtcaaatggcccctgcccccgctctcaccgccacatccgtcctgaagcgttcccacctacccggcgtccactcgttggcctgtcgccggcagccgggggcggaccgcgtctcggtgctttctccagcgatcccgccgccccgcgtttcatggcagcaaggatctggagtggttgctaagaggctcctctgggcgagtgcgagtggttccttcgagaaagataacatcggggaggacgcggtgttgccttctcagatagcggtggagaataaagtagattttttgaagattttaaagagtgccaactccattattccccatatagtgctggggagtacaattctcgccctggtgtacccgccttcgtttacatggttcactaccaggtattatgcaccagctttggggttcttgatgnnttgctgtggtgtaaaactcagtgccaaggattttatgaaagcataaagagccagatgctattgctgncggctatatcggacagtttgtcatcaagccctttgttggatccctttttgcactcttgcggttgcagttcttacctccca

SEQ ID NO: 37282 - DNA, 726 bp, Zea mays
  misc_feature: Ceres CLONE 1422733-F
  misc_feature: Encodes the peptide sequence at SEQ ID NO. 37283
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaaaaccgccggtcaagtccctgatggacacgccgccgccctctctcccgccgtccaccctcctctggccggacctcctcgcgggcgcggcgtcctccacctgccgcctcgtcgccgcgcattcccgtcacttcctggccctatcctctctcctccttctcccgctcgccctcctcctactcgccctcccctgcccgttcttctctgcctccgcctcctccgccgcctcccctcccgtacatctccgggtcccgcaggatccgtcaaggtacccactacccatcccgctgccgctgctcgcccttgccgccgcgctcctctacctcgccgccttcgccgccgccgcggccagcgcgcacgcagggttcttcggtcgccccgtccggctcctcgcctcgctccgctccgtgccagcctcactcctccgcctcatcctgaccgccatcccggcctccccgctggcactccttccgctcctcccgctccccgcggcgctcggcgccgcactgcccgtcctcggcttcatccttttgtccccgttctggtccctcgctggcgccgctgctgtggtcgaatcggccacaggcttcacgccgctccngcggagctgccagctcctctctaccgc

SEQ ID NO: 37283 - protein, 201 aa, Zea mays
  misc_feature: Ceres CLONE 1422733-F
  misc_feature (193)..(193): Xaa is any aa, unknown, or other
MDTPPPSLPPSTLLWPDLLAGAASSTCRLVAAHSRHFLALSSLLLLPLALLLLALPCPFFSASASSAASPPVHLRVPQDPSRYPLPIPLPLLALAAALLYLAAFAAAAASAHAGFFGRPVRLLASLRSVPASLLRLILTAIPASPLALLPLLPLPAALGAALPVLGFILLSPFWSLAGAAAVVESATGFTPLXRSCQLLST

SEQ ID NO: 37284 - DNA, 778 bp, Zea mays
  misc_feature: Ceres CLONE 1422737-F
  misc_feature (278)..(278): n is a, c, t, g, unknown, or other
  misc_feature (299)..(299): n is a, c, t, g, unknown, or other
  misc_feature (345)..(345): n is a, c, t, g, unknown, or other
  misc_feature (378)..(378): n is a, c, t, g, unknown, or other
cagagctggagctccccgcggtggcggccgctctagaactagtggatcccccgggctgcaggaattcgcacgagaccattacctagaacatcctaatcgaaaaaccagatctcgaggcagcggagtccggggacgccgttctttccgttgtgcttcctttgcctcttgctgccggtggccggtgattttcccgaggtctgtttgggcggcaggtagaggctattttcttggcggctggtgggatggatagccacgccgccgggtcgagctccggcggntccggggatggcggcgcgcancccaggaggagctcccagaacccacgtattccagtttactcagcangagcttccagcttttgcagcgatttctactccnaaatgggtatttcagtattcggtcttggtggcgtgatttttgcctccaatgggtattgtttccctgcgagctttccaacagggtttccaaaatccttttatccggattgatgatccaggtgtcccctcgctggggtgaattgaaaaattttccttacttcccggatgtgatttttcccaaaaagtctcccacgggttcttggccttttcccaggttttggacgccccccatttttttggtttttacccgggggggaatttttcccccaactttggggggtgttttcaccggccccttttgttccccccccaaaaaaaaaaaaggggggggggggttttttcccccttttggccccccggcgcccacaaggtgggagaaaaaaactttttgttttgttttt

SEQ ID NO: 37285 - DNA, 663 bp, Zea mays
  misc_feature: Ceres CLONE 1422743-F
  misc_feature: Encodes the peptide sequence at SEQ ID NO. 37286
tggagctccccgcggtggcggccgctctagaactagtggatcccccgggctgcaggaattcgcacgagaccattacctagaacatcctaatcgaaaaaattacaagtataactccattcccctccgtcctcccgcatcaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattgcaagcaatcctgggcttgcacggattgctctgagatgaagcttttgccttagggacggtccagccgcgcagggggcacggcggggggggccacggggcattatggggcctcaaacttcgtaa

SEQ ID NO: 37286 - protein, 110 aa, Zea mays
  misc_feature: Ceres CLONE 1422743-F
  misc_feature (3)..(111): Pfam Name: Coatomer_E Pfam Description: Coatomer epsilon subunit
MASPDLLFNLRNLFYLGAYQAAINNSDVPGLDADAAAERDAIVFRSYIALGSYQLVISEIDSSAATSLQAVKLLALYLTGDKEGAISSLKEWLSDSAIASNPGLARIALR

SEQ ID NO: 37287 - DNA, 669 bp, Zea mays
  misc_feature: Ceres CLONE 1422776-F
aaagctggagctccccgcggtggcggccgctctttcctagtggatcccccgggctgcaggaattcgcacgagaccattacctagaacatcctaatcgaaaaattataaaccttcgccaagattctctctctatacctcttcctttctctctccgtcggcgatgcaaaggctttccatagacgcatcagcttcgaagctccagagctacgatatcaatgactccaatcggaaagaatcactctcctctcctcctccttcttcgtcatcgtccgctccagattacgacgatcacgacctcaaggacgttaagctcagacggctatcgtcgctgcaatcgcctcatcagaaacgcgagaacctcgtccacttcatccccgtcctcactctaatctgcttcgtcatcctctacctctcttctcacgctccgtcgcaatcagatttggctcagtttaacggattcatgcgttcatcaaagcgtctagaatccgacgaagatggcgaaatctctgggctgatgatcggtaccgacgcttcggctatccggagtagcataaggaagttgagagagacggaatcgcttccccgccgccgaacctctcaccggaaaacagctgacttctagctttttttcactcacatcgtcttcttgtgttttgttcattgaactca

SEQ ID NO: 37288 - DNA, 639 bp, Zea mays
  misc_feature: Ceres CLONE 1422777-F
  misc_feature: Encodes the peptide sequence at SEQ ID NO. 37289
  misc_feature (177)..(177): n is a, c, t, g, unknown, or other
  misc_feature (195)..(195): n is a, c, t, g, unknown, or other
  misc_feature (256)..(256): n is a, c, t, g, unknown, or other
  misc_feature (265)..(265): n is a, c, t, g, unknown, or other
  misc_feature (268)..(268): n is a, c, t, g, unknown, or other
  misc_feature (312)..(312): n is a, c, t, g, unknown, or other
  misc_feature (380)..(380): n is a, c, t, g, unknown, or other
ctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcangggctagccaacgagacngcagcaatggcggaccgtgaacgcagcggcatctacagcgggcgcccacgccacctactgncagcaacancancagggaagaggccggcggccccattaggtaaaacaggtaaaggnctgctccacgacaaggggcccaacgcgtcccaagcgcttaaacgtggcaacctttttccctctgggcnggctgctccttgttggttttcggggctggcgctaaacgactcctggtggggggtgtgccttggcccccccctgtgtttctcataattttttccccccgtgtttgtcccccccgcccccctctcattcggaaaggccgtcatggggttttctcacactccggggcccctttggttcccggggccttttttccctccaaattgccttcccaacaaaagggggggggaagggtttttaccccgaccccccaaaattattgga

SEQ ID NO: 37289 - protein, 87 aa, Zea mays
  misc_feature: Ceres CLONE 1422777-F
  misc_feature (19)..(19): Xaa is any aa, unknown, or other
  misc_feature (22)..(22): Xaa is any aa, unknown, or other
  misc_feature (23)..(23): Xaa is any aa, unknown, or other
  misc_feature (60)..(60): Xaa is any aa, unknown, or other
MADRERSGIYSGRPRHLLXATXXGKRPAAPLGKTGKGLLHDKGPNASQALKRGNLFPSGXAAPCWFSGLALNDSWWGVCLGPPLCFS

SEQ ID NO: 37290 - DNA, 669 bp, Zea mays
  misc_feature: Ceres CLONE 1422778-F
  misc_feature: SWISSPROT Homolog: EC 3.4.25.1 Proteasome endopeptidase complex
  misc_feature (561)..(561): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (601)..(601): n is a, c, t, g, unknown, or other
  misc_feature (633)..(633): n is a, c, t, g, unknown, or other
aagctggagctccccgcggtggcggccgctctagaactagtggatcccccgggctgcaggaattcgcacgagaccactacctagaacatcctaatcgaaaaaacttcgttcgcaagaagctcagaagtcacatcacaagccgccgaggggaggcgccgacgccgagtttttgctccatcccgcatccaccgccagaatgtttctcacgaggacggagtacgaccgcggggagaacaccttctcgccggaggggcggctgttccaggtctagtacgccatcgaggccatcaagttgggatccactgcgatcgggttgaagacaaacgatggtgttgtccttgctgttgagaaacgtgtgacctccccactgctggaaccaagcagggtggaaaacatcctggaaattgatgagcacataggctgtgccatgagggggcttattggttgatgctagaacacctaggcgaggatggttcgcggtgaacactcaaagtgtggggttctcataggcggagcccatggaccgagggattttggatcccagccaatttctggcttagngtttgcctctttgnnnnaaagggggaggaaaaagctcaangtgcccggccttttggggagcgtccccccgtnaatttgacgggcattcactgcagaaaggcaaccaga

SEQ ID NO: 37291 - DNA, 609 bp, Zea mays
  misc_feature: Ceres CLONE 1422779-F
  misc_feature: Encodes the peptide sequence at SEQ ID NO. 37292
  misc_feature (261)..(261): n is a, c, t, g, unknown, or other
  misc_feature (262)..(262): n is a, c, t, g, unknown, or other
  misc_feature (290)..(290): n is a, c, t, g, unknown, or other
  misc_feature (322)..(322): n is a, c, t, g, unknown, or other
  misc_feature (323)..(323): n is a, c, t, g, unknown, or other
  misc_feature (345)..(345): n is a, c, t, g, unknown, or other
  misc_feature (354)..(354): n is a, c, t, g, unknown, or other
  misc_feature (377)..(377): n is a, c, t, g, unknown, or other
aaagctggagctccccgcggtggcggccgctctagaactagtggatcccccgggctgcaggaattcgcacgagaccattacctagaacatcctaatcgaaaaccagcctcgccgccccaccaccccagcattgccttaccttgccttgccttcccctccattccacctccacctcgccgcccgaatcccccccaacccaacaatcccccatggggtcgctggccatcgaggcgcaccgcgcgggcgcggaggtgtaccgcnngcgcgcgctgtgcgcggaagagtcgacngagctgctggcagaagcgcacctcccgctggnnctgctgccgctggccgacatgnaagaagtcngctacaaccgcgcacgggcttcntggtgctgcgcaaaagaagtcgctcacgcaaccgttccgcccaatccccgccagggtccgtacccccccaaagtcacgcccttcgggaagaaccggcgaataaaaccataaccgggttaaaaacaaggagcccccccatcggggccccctccccaaaattttccccaaaggggaaaaaccccccaaaaaaccctttaaaaaccccccccggggttggggggaccaacccccc

SEQ ID NO: 37292 - protein, 92 aa, Zea mays
  misc_feature: Ceres CLONE 1422779-F
  misc_feature (18)..(18): Xaa is any aa, unknown, or other
  misc_feature (38)..(38): Xaa is any aa, unknown, or other
  misc_feature (46)..(46): Xaa is any aa, unknown, or other
  misc_feature (49)..(49): Xaa is any aa, unknown, or other
MGSLAIEAHRAGAEVYRXRALCAEESTELLAEAHLPLXLLPLADMXEVXYNRARASWCCAKEVAHATVPPNPRQGPYPPKVTPFGKNRRIKP

SEQ ID NO: 37293 - DNA, 574 bp, Zea mays
  misc_feature: Ceres CLONE 1422784-F
  misc_feature: Encodes the peptide sequence at SEQ ID NO. 37294
  misc_feature (380)..(380): n is a, c, t, g, unknown, or other
  misc_feature (381)..(381): n is a, c, t, g, unknown, or other
caaagctggagctccccgcggtggcggccgctctagaactagtggatcccccgggctgcaggaattcgcacgagaccattacccagaacatcctaatcgaaaacacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagcccgatccgaccgagagctagccaccgcgatgccgaggtcttccaagatgatgggtggcggggcagctttttgcttggccttttggcccttgggcggttgtaattcccgaggggggggagaaaaaatctcttnnccccccccccccccccgggaaaaaaaagaaaacccgggggggtggaaaaaattactccccttaacacccccgggggggggccccccccgggggggggccccccccggggattttttttggaaaacttctgggttttttatccgcgggggggaaaaccccccccttttttttttctcgcgggggggggcgcctc

SEQ ID NO: 37294 - protein, 60 aa, Zea mays
  misc_feature: Ceres CLONE 1422784-F
KLELPAVAAALELVDPPGCRNSHETITQNILIENTITHHSTAVARGIEQGHTHTHTTRLA

SEQ ID NO: 37295 - DNA, 667 bp, Zea mays
  misc_feature: Ceres CLONE 1422790-F
aagctggagctccccgcggtggcggccgctctagaactagtggatcccccgggctgcaggaattcgcacgagaccattacctagaacatcctaatcgaaaaagttcctacgccgcggcggcgcggcctctccattccggtgtgttctccgatttgggggacgtcccttgcccacttcggagtccggtccagcggagccagctacggcacagatcggcttccgtccgccccttcccatctcgacagactctgctccgccgcggtgatcgtgcctcggatgcttcctagattactgcttcaggtcgtgctgatgcaaaatggttctatgtcaggacgtattctgttggaagtgctcacttgctagcttttcctggtagatcatctagttttaagagcaccccttttgctgttgagactgatcatttttctgctagagctctccctgcctggactgattccattcatcatggtatgtgaaatgttctccccaaggagaagtttcctcaagggaattccttccactatcaggggcagataaatcacccttgccagggacctatttgtctgttaggtggtgcctcgactgggatctgttttaacctaccctgtaggctgacccctccctaacccaggatgggcggggtggaaaaacttccttggcctggggg

SEQ ID NO: 37296 - DNA, 631 bp, Zea mays
  misc_feature: Ceres CLONE 1422792-F
  misc_feature: Encodes the peptide sequence at SEQ ID NO. 37297
atagctggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggagaaacaggtgaaggaaattgtgttgaatgctatgggacaggctataagcaacgcagtggctattgctgatatcataaagaagaggattcctggtttgcatcaagatacaataatcagttctgtcagtattactgatgtatgggagcccattgaggaaggacttgtaccattggagatgactcgtcatgtgtcaatgatatcgattt

SEQ ID NO: 37297 - protein, 111 aa, Zea mays
  misc_feature: Ceres CLONE 1422792-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLNAMGQAISNAVAIADIIKKRIPGLHQDTIISSVSITDVWEPIEEGLVPLEMTRHVSMISI

SEQ ID NO: 37298 - DNA, 648 bp, Zea mays
  misc_feature: Ceres CLONE 1422808-F
  misc_feature: Encodes the peptide sequence at SEQ ID NO. 37299
aagctggagctccccgcggtggcggccgctctagaactagtggatcccccgggctgcaggaattcgcacgagaccattacctagaacatcctaatcgaaaaactcctcatcgccacaagtgaagtcaccgacgcacgcacggctgcagcgcgctcctactctcccgcgaccgccaccggggaggggcaatagaatatagcgaggacagccaatgcaggccgccgtcaacaccaccactgtcggcgctcacccgcacccaacaaagtcctcgttcctccgtccatcccctccttgccgcgtctacttccacgcttctccacgcccgaaccatagggcgatcgccatggccagcaagtcgcagctgcaggagcaactgatcatcactcgccccaacgactggcacctccatcttcgcgaaggcggtgtcctcgaggctgtagtgccacacagcgcgaggcattttgggagggccatcatcatgcccaacctgaagccgccggtgaccacaacggcgcgggccatggagtacagggaggagataatgagggcgctgccgccagggagtagcttcgagccgctcatgacactatacctcacagacaacacaagcccagaggagatcaagctcgcaagaaagagtggtataat

SEQ ID NO: 37299 - protein, 101 aa, Zea mays; identical to SEQ ID NO: 36841
  misc_feature: Ceres CLONE 1422808-F
  misc_feature: SWISSPROT Homolog: EC 3.5.2.3 Dihydroorotase

SEQ ID NO: 37300 - DNA, 718 bp, Zea mays
  misc_feature: Ceres CLONE 1422831-F
  misc_feature: Encodes the peptide sequence at SEQ ID NO. 37301
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (47)..(47): n is a, c, t, g, unknown, or other
  misc_feature (48)..(48): n is a, c, t, g, unknown, or other
  misc_feature (51)..(51): n is a, c, t, g, unknown, or other
  misc_feature (54)..(54): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (85)..(85): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (94)..(94): n is a, c, t, g, unknown, or other
  misc_feature (95)..(95): n is a, c, t, g, unknown, or other
  misc_feature (106)..(106): n is a, c, t, g, unknown, or other
nnnnccccccccaaaccccnnnncnnnncaaaaaccaaacacaaaannaanaanaaaggaaaaacaannnngggggggtgggggnttgtnnntnnttcaaagcggngctccccgcggtggcggccgctctatttcagaggaggcgctgggctgcagggaattccccgagagcgttacctagaacatcctaatcgaaaaatcgcacatattagttagaccaactagcaacatagaaagcacaatagtgaaccaacgatggcagccaaaatattttgcctcctgatgctccttggtatttctgcaagtgctgctacggcgaccattttcccgcaatgctcacgagcgcctatagcttcccgtcgacccccgaacctctcaccagcggtgtcttcggtatgtgaaaacccaaatcttcaaccctacaggatccaacaggcaatcgcagctggcatcttacctttatcacccttggtcctccaacaagcagcagccctattacagcagatacctttggtgcatttattggcacaaaacatcagggcacaacaactacaacaacttgtgctagcaaaccgtgctggctacacgcagcaacagcaggttcttccattcaaccaactagctgcattgaactctgcatctgagttgcaacaacaacgactaccattcagccagctagctgttggctacccccagcaatttcttcgattgaaccaac

SEQ ID NO: 37301 - protein, 154 aa, Zea mays
  misc_feature: Ceres CLONE 1422831-F
MAAKIFCLLMLLGISASAATATIFPQCSRAPIASRRPPNLSPAVSSVCENPNLQPYRIQQAIAAGILPLSPLVLQQAAALLQQIPLVHLLAQNIRAQQLQQLVLANRAGYTQQQQVLPFNQLAALNSASELQQQRLPFSQLAVGYPQQFLRLNQ

SEQ ID NO: 37302 - DNA, 714 bp, Zea mays
  misc_feature: Ceres CLONE 1422837-F
aaactggagctccccgcggtggcggccgctctagaactagtggatcccccgggctgcaggaattcgcacgagaccattacctagaacatcctaatcgaaaaaccaccaccactggatcttcggaccattagctttatcgactcgtgagcgtagaataaccctgtcgaccccttgtgggtgtcgctcgtggccctcgctctcctggatgtggctgggagggccaccttcgagcacgccagcggcgggtgctgctgccaggcacggttgccggttcatctacagccgctggtgcatctgccacctcaggttcaggtgggacctcctgtgcatcactcatcgtcggggaacctgccgacgctggtctagctgttgccgccggctggtgtgctgccgacggttcatctgccgccgcctccatgcaccttctctatggaactgggccgtccttactctgttccccaggcacacccttacctgcgccaccagcagcggtcactccgtgccagctgcgtgtcatctgtggcggcagcagctctccgatggtgggccctgcgccgagtacgtgtacgataagtgcctgctgacggctacgtcttactgctcggcgcagggataaacatttctgtcgctgcgttaccagcacataccgtaactcggatccgtcggaatctttgcacgcatatcatcagctagggtctccactcgagaccaggg

SEQ ID NO: 37303 - DNA, 732 bp, Zea mays
  misc_feature: Ceres CLONE 1422848-F
  misc_feature: Encodes the peptide sequence at SEQ ID NO. 37304
  misc_feature (435)..(435): n is a, c, t, g, unknown, or other
  misc_feature (493)..(493): n is a, c, t, g, unknown, or other
aaaagctggagctccccgcggtggcggccgctctagaactagtggatcccccgggctgcaggaattcgcacgagaccattacctagaacatcctaatcaaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgcccgccgcacccatgcactaccctactncacccgccccggctcagcctcatccccagccacacccatggccggtggcaacaggcgnatccaagcccggtgccagttgcagggaaacctgggggggttggaagcacccgaatcccggggccaagggcgtcaagtttcggaggttattaggggaaccggaaggggaacccctaaggtttcccctaaaggccaatttttggcgaaaaaagtttttccccaccttccggggggggaggcccccaccccggacaccggggttttttggtttggcccccccgccccctctgggaaaaagcc

SEQ ID NO: 37304 - protein, 86 aa, Zea mays
  misc_feature: Ceres CLONE 1422848-F
MAGGNRRIQARCQLQGNLGGLEAPESRGQGRQVSEVIRGTGRGTPKVSPKGQFLAKKVFPHLPGGEAPTPDTGVFWFGPPAPSGKK

SEQ ID NO: 37305 - DNA, 638 bp, Zea mays
  misc_feature: Ceres CLONE 1422852-F
  misc_feature: Encodes the peptide sequence at SEQ ID NO. 37306
  misc_feature (343)..(343): n is a, c, t, g, unknown, or other
  misc_feature (399)..(399): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcncaggcgctgacggtggtgacgctgttcccgctggggcggctgctgctggtgctgtncgggctggcgctgacggcctccgtggtgggggctggccgggccaccccggtgttcctggatctcaaccccgggctcgtccccgccgcgctgctcatcgggacggccgtcatggggtccttcacctcgggcgcgctggggctcgggggcctgtcctcgttcaggggcctgccaaaagggcggggaaggcgttccagcgcaccccggactaggggaggaggcgaccgcaggatggccgaag

SEQ ID NO: 37306 - protein, 144 aa, Zea mays
  misc_feature: Ceres CLONE 1422852-F
  misc_feature (44)..(141): Pfam Name: Oleosin Pfam Description: Oleosin
  misc_feature (65)..(65): Xaa is any aa, unknown, or other
MADRDRSGIYGGAHATYGQQQQQGGGGRPMGEQVKGMLHDKGPTASQALTVVTLFPLGRLLLVLXGLALTASVVGAGRATPVFLDLNPGLVPAALLIGTAVMGSFTSGALGLGGLSSFRGLPKGRGRRSSAPRTRGGGDRRMAE

SEQ ID NO: 37307 - DNA, 712 bp, Zea mays
  misc_feature: Ceres CLONE 1422860-F
  misc_feature: Encodes the peptide sequence at SEQ ID NO. 37308
  misc_feature (567)..(567): n is a, c, t, g, unknown, or other
  misc_feature (585)..(585): n is a, c, t, g, unknown, or other
  misc_feature (589)..(589): n is a, c, t, g, unknown, or other
  misc_feature (696)..(696): n is a, c, t, g, unknown, or other
tctgaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaaaaatggccggaattggcaggaacatggtggcgccgctcctggtgctcaacctcatcatgtacatcatcgtcatcggcttcccgagctggaacctgaaccacttcatcaacgggcagaccaactaccccggcgtggccggcaacggggcgacgttctacttcctggtgttcgccatccctgaccggcgtggtgggcgctggcgtcaagctgggggggcgtgcaccacgtggcgcgcctggggtccacgacagcctggnccaccaaaccccccggtnaccncttagtcaccctggtgcaatcaaggggacctcgcctttctaggctcggcccggcaagggagtactcccattcgggcggcaaaaccacaggcttgtgcgcctctcccncatttccttgaaaagt

SEQ ID NO: 37308 - protein, 92 aa, Zea mays
  misc_feature: Ceres CLONE 1422860-F
  misc_feature (14)..(82): Pfam Name: AWPM-19 Pfam Description: AWPM-19-like family
MAGIGRNMVAPLLVLNLIMYIIVIGFPSWNLNHFINGQTNYPGVAGNGATFYFLVFAIPDRRGGRWRQAGGACTTWRAWGPRQPGPPNPPVT

SEQ ID NO: 37309 - DNA, 650 bp, Zea mays
  misc_feature: Ceres CLONE 1422867-F
  misc_feature (507)..(507): n is a, c, t, g, unknown, or other
  misc_feature (508)..(508): n is a, c, t, g, unknown, or other
  misc_feature (566)..(566): n is a, c, t, g, unknown, or other
  misc_feature (567)..(567): n is a, c, t, g, unknown, or other
  misc_feature (576)..(576): n is a, c, t, g, unknown, or other
aaagctggagctccccgcggtggcggccgctctagaactagtggatcccccgggctgcaggaattcgcacgagaccattacctagaacatcctaatcgaaaaatcccatcccctcaagcctcagtcgtgtgtccctatatcactaacgatacactgctctgctgaagcaagaacgatgaagctagcgcctccctagctctcgttgtcagtaatggccaccaccgatgcgtgcagcctcctcaggatctccttcgcgggatcacggctaactgttgccaggcgcactaccacaacctttcccgtggatgtgagcaccctctgggccgacagttgcacgatctaggcctagattagaatttcccaaaaggctatctaaacctgggaggagtcgggtggggaaactgtggtgctccgcggatccgggagatgtcctgaggtggagacgggctgggcccgatgcaagggcgtccgccgggggggggggggctcgggccctgggggccaggnncgagaatcccggtcggccacaggggcgtgccatactttgcccccccgggggggaggannttgattttntggcgcggggttcctttcttggcaacccccaccgccctcccccccttgggccaccccctctctcccctcccctg

SEQ ID NO: 37310 - DNA, 654 bp, Zea mays
  misc_feature: Ceres CLONE 1422868-F
  misc_feature: Encodes the peptide sequence at SEQ ID NO. 37311
  misc_feature (497)..(497): n is a, c, t, g, unknown, or other
atagctggagctccccgcggtggcggccgctctagaactagtggatcccccgggctgcaggaattcgcacgagaccattacctagaacatcctaatcgaaaaaattcacgcccccaccacgacttccgtgctcgccgccttctcggactaggggggttcggctcaagatctgatttcgaggcgcccgacgactacatggaggttaaggagatggcgatggccgcagcggctgcggctgctgcgtccggcgggggaggcgtcaagctgcccccacccaatcccaacctgccctacagggaggactgctggagcgaccgcgagacggcagctctcgtctccgcctggggcagccgctacgtcgagctcaaccgcggtaacctgcaccagatgcagtggcaggatgaggaggactgcctctactcacgccggggagactccgcgcggcggccgccatcgcgacacgacggtctgtgcaagaaccgcgacgataccctcangatgacgtacagggccgagctcgcccccaaaggagcgaccggcctggtcctactttcccaagctcgaccggcttggctggcccaaccctcagcgccttcgcctccaagagacacctggggttcgcgccctcctcaattcgctttgcccatgccatcc

SEQ ID NO: 37311 - protein, 153 aa, Zea mays
  misc_feature: Ceres CLONE 1422868-F
  misc_feature (101)..(101): Xaa is any aa, unknown, or other
MEVKEMAMAAAAAAAASGGGGVKLPPPNPNLPYREDCWSDRETAALVSAWGSRYVELNRGNLHQMQWQDEEDCLYSRRGDSARRPPSRHDGLCKNRDDTLXMTYRAELAPKGATGLVLLSQARPAWLAQPSAPSPPRDTWGSRPPQFALPMPS

SEQ ID NO: 37312 - DNA, 647 bp, Zea mays
  misc_feature: Ceres CLONE 1422883-F
  misc_feature: Encodes the peptide sequence at SEQ ID NO. 37313
  misc_feature (46)..(46): n is a, c, t, g, unknown, or other
ggagctccccgcggtggcggccgctctagaactagtggatcccccngggctgcaggaattcgcacgagaccattacctagaacatcctaatcgaaaaacccatattattgataccaactagcaacatacatagtgaagtacactagcaacatcttagcaccaatggcagccaagatttttgccatccttgccctccttgctctttcagcaagcgttgctaccgcgactattattccacaatgctcacaacaatacctctctccggtgacagccgcgagatttgaatacccaactatacaatcctacaggctacaagaggccatcgcagcaagcatcttacggtcgttagcattgaccgtccaacaccatatgccctattgcaacaaccatcttaatgaatctatatctccaaaagatcgcaggcacacaactacaacaacagttggcttcaaacatcaatcaagtagttgcagccgaccttggctggtttacctccaggaacaaacaatttttttccatttcaacaaaataagtgggggggaaaccctggtttgttatttttggggggacaaaaaggtttttttccccttttaacccaattttttaggggacccctttgttcctttttttaattggaaaaacatttt

SEQ ID NO: 37313 - protein, 143 aa, Zea mays
  misc_feature: Ceres CLONE 1422883-F
MAAKIFAILALLALSASVATATIIPQCSQQYLSPVTAARFEYPTIQSYRLQEAIAASILRSLALTVQHHMPYCNNHLNESISPKDRRHTTTTTVGFKHQSSSCSRPWLVYLQEQTIFFHFNKISGGETLVCYFWGDKKVFFPF

SEQ ID NO: 37314 - DNA, 744 bp, Zea mays
  misc_feature: Ceres CLONE 1422886-F
  misc_feature: Translation starting site: 253
  misc_feature (13)..(13): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (52)..(52): n is a, c, t, g, unknown, or other
  misc_feature (53)..(53): n is a, c, t, g, unknown, or other
  misc_feature (63)..(63): n is a, c, t, g, unknown, or other
ggtggtggttttnaggtggggaggatganggccccccnnnnnnnntnngggnnaagggggtgnacaaactgggactccacgcggtggcggccgctctagaactagtggatcccccgggctgcaggaattcgcacgagaccattacctagaacatcctaatcgaaaaatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtggagcgcatctcggggctcatctacgaggagacccggcggcgtgctcaagatcttcctcgagaacgtcatccgggacggcggcacctacaccgagcacgcgcgccgcaagaccggccaccgccatgaacgtcgcttacgggcttaaggggcaggggcccacccttctacggattccggagggtaggggccctcttcccaaattggggaaagggcttaagggggaaaacccgccctctgccccggggggggccaaaagggggggcgggcggtccccggggggggaaaaccccttttatttttttccacaaaaaaaaaaaagggtgggggaaaaaattttccccccgggatagggccaaaaaa

SEQ ID NO: 37315 - DNA, 674 bp, Zea mays
  misc_feature: Ceres CLONE 1422894-F
  misc_feature: Encodes the peptide sequence at SEQ ID NO. 37316
  misc_feature (359)..(359): n is a, c, t, g, unknown, or other
  misc_feature (360)..(360): n is a, c, t, g, unknown, or other
  misc_feature (561)..(561): n is a, c, t, g, unknown, or other
acaagctggagctccccgcggtggcggccgctctagaactagtggatcccccgggctgcaggaattcgcacgagaccattacctagaacatcctaatcgaaaaaatagtccgagttactcggaggaatccatgtgcggcggtgcaatcatcttggactacatcccggcgcggcgccgggtgtccgccgccgacttctggcctgactccgaagccgacgccgaggactccgactcgcacgcccctgaccctgagagagcgccgcgcccgcgcgggaaggcgaagcgtgggcgcaagaaccagtaccgcggcatccggcagcggccgtggggcaagtgggcggcggagatccgcgacccgnntgaagggcgtgcgcgtctggctcggcacctaccccaccgccgaggccgccgcgcgcgcgtacgaccgcgctgccaggcgcatcaggggcgccaaagctaaggtcaacttccccaacgagacctcctcctccagcgtcaccgcgccgacggcggcatctgggggctgctgctgctgcacgggcccccggccgttctccgggngcccaaggtgggagcgcgcacgcaggtggtccgacgagttcaaacgggctgtcggagagctaatggcctacgagactacatgagcttttcttcgcgtccggtacattgagggg

SEQ ID NO: 37316 - protein, 109 aa, Zea mays
  misc_feature: Ceres CLONE 1422894-F
  misc_feature (77)..(77): Xaa is any aa, unknown, or other
MCGGAIILDYIPARRRVSAADFWPDSEADAEDSDSHAPDPERAPRPRGKAKRGRKNQYRGIRQRPWGKWAAEIRDPXEGRARLARHLPHRRGRRARVRPRCQAHQGRQS

SEQ ID NO: 37317 - DNA, 699 bp, Zea mays
  misc_feature: Ceres CLONE 1422896-F
  misc_feature: Encodes the peptide sequence at SEQ ID NO. 37318
aaagctggagctccccgcggtggcggccgctctagaactagtggatcccccgggctgcaggaattcgcacgagaccattacctagaacatcctaatcgaaaagaagtctatctttttctcctcctgccgtacgtccgttccagcttgcaaagcgctcgcgagctgctgccatggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccggcgcctctgggccgcctgcgaggccgaggctggataccgcgtgctcaccccgacgccgcacctctccatgggcccgcggagcagcgcctcgctcgccgccgccatcgctaacatgggcgtcgaggatgtggaccaggactaccctcaccgcaggtggggaggcgccttcccactcaccgtccggaaccgggggacgcgtgagtcacagcgctcagcgaccatgtcggggtgctccatgccaccaagagcgtgtccatgtttcaatccctcgcccgtctaag

SEQ ID NO: 37318 - protein, 175 aa, Zea mays
  misc_feature: Ceres CLONE 1422896-F
  misc_feature (20)..(162): Pfam Name: DAO Pfam Description: FAD dependent oxidoreductase
  misc_feature: SWISSPROT Homolog: EC 1.5.3.1 Sarcosine oxidase
MAGAGAPAVPQAGRPAPNFDVIVVGAGIMGSCTAHAAASRGARVLLLERFDLLHPLGSSHGDSRIIRDAYAQPRYLRMVRLARRLWAACEAEAGYRVLTPTPHLSMGPRSSASLAAAIANMGVEDVDQDYPHRRWGGAFPLTVRNRGTRESQRSATMSGCSMPPRACPCFNPSPV

SEQ ID NO: 37319 - DNA, 614 bp, Zea mays
  misc_feature: Ceres CLONE 1422898-F
  misc_feature: Encodes the peptide sequence at SEQ ID NO. 37320
gccggaatgccacgagagcgttacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgccttcatcttgacagcg

SEQ ID NO: 37320 - protein, 123 aa, Zea mays
  misc_feature: Ceres CLONE 1422898-F
  misc_feature (16)..(121): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATGAFILTA

SEQ ID NO: 37321 - DNA, 633 bp, Zea mays
  misc_feature: Ceres CLONE 1422903-F
  misc_feature: Encodes the peptide sequence at SEQ ID NO. 37322
aaagctggagctccccgcggtggcggccgctctagaactagtggatcccccgggctgcaggaattcgcacgagaccattacctagaacatcctaatcgaaaaatccatcatcgctcgctcttctcttggtcttgcaactccagtgctgctcactgccactgccagcagatcgagctgctccgcctcactagccctcttgctttgctgctgcacctgcaagtctgcaaccgcgcacagagagatgtcgacggtgagccgtgcgtccctcgaccagaagctcgccctcgccaagcgctgctcccgagaggcgaccctcgccggagccaaggcggcagcggtggcgactatcgcctccgcgatccccaccctggccagcgtgcggatgctgccatgggccaaggccaacatcaaccccaccggccaggcgctcatcgtctccacggtggctgggatggcatacttcatcgccgccgacaagaagatcctgtcgctggcgaggcgccactcgttcgagcaagcccctgagcacctcaagaacacctccttccagggcaccggccgtccccacctggctttcttcaggccgtgagacgtggcctccgtcgagctagctacctacctctttcagttcga

SEQ ID NO: 37322 - protein, 115 aa, Zea mays; identical to SEQ ID NO: 37038
  misc_feature: Ceres CLONE 1422903-F
  misc_feature (11)..(89): Pfam Name: ENOD93 Pfam Description: Early nodulin 93 ENOD93 protein

SEQ ID NO: 37323 - DNA, 713 bp, Zea mays
  misc_feature: Ceres CLONE 1422908-F
  misc_feature: Encodes the peptide sequence at SEQ ID NO. 37324
  misc_feature (599)..(599): n is a, c, t, g, unknown, or other
  misc_feature (645)..(645): n is a, c, t, g, unknown, or other
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaaaacaacagcagcccccggggccacagggcgcaggcccgcagccatggaccaggaccacaagaggctagtactcccgtcgccggcgccgcagtccccgccggcatccgccgcgtcggcgtcgaccacggcctcgccgtactccgcgctacaccctctcctcttgccctccccgaacccgcacctcttcctgaagcccaagacgctaactctctccctctcgtcctcctccctcacctccatgtcctcctcctcgctgcccgcccccgtcaccgatgtctgggaggtcgtcacccccactgccccatctgttgaccacgtggacggcgggcttgatgactgcgccatcttcccgccgcggctgcatgaggggctgggcctggacggcgagcccgaggaggtcccgccgatgccagcagtggcgaaggaggagaacgaggaggatggtgaatacgagggggaggacgatgagtggctgtggggaattgggagaggtgcancttggcggcaaggcgcgcttgggcggccggtgtcgggatcgttcangagcgggtgctcgtgcatggcncgtgtgggtgccccggcgtgaagcccgccgtgtggtcggttgcggt

SEQ ID NO: 37324 - protein, 180 aa, Zea mays
  misc_feature: Ceres CLONE 1422908-F
  misc_feature (152)..(152): Xaa is any aa, unknown, or other
  misc_feature (167)..(167): Xaa is any aa, unknown, or other
MDQDHKRLVLPSPAPQSPPASAASASTTASPYSALHPLLLPSPNPHLFLKPKTLTLSLSSSSLTSMSSSSLPAPVTDVWEVVTPTAPSVDHVDGGLDDCAIFPPRLHEGLGLDGEPEEVPPMPAVAKEENEEDGEYEGEDDEWLWGIGRGAXWRQGALGRPVSGSFXSGCSCMARVGAPA

SEQ ID NO: 37325 - DNA, 563 bp, Zea mays
  misc_feature: Ceres CLONE 1422914-F
aaagctggagctccccgcggtggcggccgctctagaactagtggtcccccgggctgcagattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctcagcagcaccgccgccgccccagatcccagccttcgtgacccttcccgtacgagatcagatggctgggtatatgtcaagaggccccaaaatggtctgtgtatgtctgcaatctaccccctggaactgatgaaaatatgttggctgaaattttggacctaagctgggctaaaagggtatgggcccttccaaaaaggaaaaaaggacttgggcgtccaaaaattttggaattaccggggacaaatttttctaaacacccaaaggggggtagccaccccccccccttagggaaaccaccgggggtctttcccctggtggggaaaaagtgttcttaaaaaaaaagattttttctga

SEQ ID NO: 37326 - DNA, 696 bp, Zea mays
  misc_feature: Ceres CLONE 1422922-F
aagctggagctccccgcggtggcggccgctctagaactagtggatcccccgggctgcaggaattcgcacgagaccattacctagaacatcctaatcgaaaaacgccaaagatttcctcttccgcctgcgcttccctttgccccgctctcccccagcctcgctcgccatataatacgggccggccggccggccagctgggtccccgcggatgggctcggtctcgcggggctagggtttggtcggtcgtctcgccggcgtcgaggccgccagcgctgctagctagctctctcgcgttagggttccccgtagccatggtgctgcagcgcttctcgtggccgtacggcggcccgagcgccaccttctgcggtagcttcacccgggtggagagagtgtcccccgggggctggttgggggccccgccccaagccgtcctcgaacctgccccccccggaagttacccatcaccccttcctcccgtttgaccgcggtccggccgctctcaccgagaaaaaaaccccttttcccccccaccaaaccccggacttggtcaccaatcccccccgcctgcccggaaaacaattgttaccccccgtttcttgcccacccaaagcctttccccgcccacgtaacccaatatcggaacaaggggatccactctccccaaaaccccgcccccccccgaacccacccttcccc

SEQ ID NO: 37327 - DNA, 636 bp, Zea mays
  misc_feature: Ceres CLONE 1422932-F
  misc_feature (542)..(542): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaactctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggtcgcgccccacctccgccctctcctcctccagggggatcggatacgccacacgctgcgcgatggtgctgtgagtcttcggctacggctccctcatctggaacccccggctcgacttcgacgactaaatcctcggcttcatcaagggctacaagcgcatctttaatctcgcttgcattgaccacagaggcacaccggagcatccggcgaggacctgcacgcttgaaaccgacgacgaggccatatgctggggaattgcatattgtgtcaagggtggtccagantaagagctaacagcaatacagtacttggagagaagagagtgtgagtacgaccagaaaatatccatttgattctancaggaacgagatcccttga

SEQ ID NO: 37328 - DNA, 641 bp, Zea mays
  misc_feature: Ceres CLONE 1422944-F
  misc_feature: Encodes the peptide sequence at SEQ ID NO. 37329
aaagctggagctccccgcggtggcggccgctctagaactagtggatcccccgggctgcaggaattcgcacgagaccattacctagaacatcctaatcgaaaagtcaacgttctcccgtccccccgagcgcagtctcgcgtggttctcccgtccccccccccgtgccgtggttctccaatcctccctcatccgctctctttctttctctctcgtggcgagtggtaacgacgtcaggtgctcaggtcttgttcaggcccttcgccggcgacgagcacacagcaaatggatacaggagttcaagttatgttcatcatcagtcttgtgctctggtgtactacaagctttgccttggatgatgctgctgctacaaggattccaaatgtgggcacattacctctgtcaatgaaagaaaatccgcaattatgccaactttgtgaggagtttgcatcagaggccctcttctatttaaatgaaaatgagacccagactgaaatcattgatacactacaccaagcttgttcaaagtttggctcttttaagctggagtgcacgaagttggtggattattatgtccctcttttcttcacaaaaattgcttcattaagccctgaaagattttgtgcatcagcaagtttttgtgg

SEQ ID NO: 37329 - protein, 119 aa, Zea mays
  misc_feature: Ceres CLONE 1422944-F
  misc_feature (45)..(83): Pfam Name: SapB_1 Pfam Description: Saposin-like type B, region 1
MDTGVQVMFIISLVLWCTTSFALDDAAATRIPNVGTLPLSMKENPQLCQLCEEFASEALFYLNENETQTEIIDTLHQACSKFGSFKLECTKLVDYYVPLFFTKIASLSPERFCASASFC

SEQ ID NO: 37330 - DNA, 710 bp, Zea mays
  misc_feature: Ceres CLONE 1422945-F
  misc_feature: Encodes the peptide sequence at SEQ ID NO. 37331
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (56)..(56): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
nnnnnccccccnnnnggggnncncccnnnnnnnnnnnnnggggggggttnnnnncngcgggggggggggggggnnntcaaactggagctccccgcggtggcggccgctctaatacaaaggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcgggctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagt

SEQ ID NO: 37331 - protein, 32 aa, Zea mays
  misc_feature: Ceres CLONE 1422945-F
MSSLHATRAELGLVVLYLNKAEARDKICRAIQ

SEQ ID NO: 37332 - DNA, 645 bp, Zea mays
  misc_feature: Ceres CLONE 1422951-F
  misc_feature: Encodes the peptide sequence at SEQ ID NO. 37333
  misc_feature (431)..(431): n is a, c, t, g, unknown, or other
  misc_feature (515)..(515): n is a, c, t, g, unknown, or other
  misc_feature (522)..(522): n is a, c, t, g, unknown, or other
  misc_feature (526)..(526): n is a, c, t, g, unknown, or other
aagctggagctccccgcggtggcggccgctctagaactagtggatcccccgggctgcaggaattcgcacgagaccattacctagaacatcctaatcgaaaaagctccatcactgacacaagagagcacgctactactcatcactcgccaacgtgcagagatcagggaagcggcactccatccactgactgaccgctcatggcgaaggtccacctctacgtcgccgcggcctgcgccgtcgtcctcgcgctcgccaccccggccctcgccggtgaccccgacatgctgcaggacgtctgcccggctgactacgcctccccggtgaagctgaacgggttcgcgtgcaaggcgaacttttcggcggacgacttcttcttcgacgggctgaggaacccgggcaacaccaacaaccccgcgggctccgtggtgacngcggccaaacgtgagaagttcccgggcgtgaacacgctgggcgtctccatggcgcgcatcgactacgcgcccggcgggcagaanccgccgnaaangcacccggggggccacgagataatcttcgtcctccaacggacgctcgagggtcggctcatcaccaccgccaaacgggttcttaccaaaaacgtcacaaaggggaacttcttctttttcc

SEQ ID NO: 37333 - protein, 149 aa, Zea mays
  misc_feature: Ceres CLONE 1422951-F
  misc_feature: SWISSPROT Homolog: EC 1.15.1.1 Superoxide dismutase
  misc_feature (106)..(106): Xaa is any aa, unknown, or other
  misc_feature (109)..(109): Xaa is any aa, unknown, or other
  misc_feature (110)..(110): Xaa is any aa, unknown, or other
MAKVHLYVAAACAVVLALATPALAGDPDMLQDVCPADYASPVKLNGFACKANFSADDFFFDGLRNPGNTNNPAGSVVTAAKREKFPGVNTLGVSMARIDYAPGGQXPPXXHPGGHEIIFVLQRTLEGRLITTAKRVLTKNVTKGNFFFF

SEQ ID NO: 37334 - DNA, 647 bp, Zea mays
  misc_feature: Ceres CLONE 1422954-F
  misc_feature: Encodes the peptide sequence at SEQ ID NO. 37335
aaagctggagctccccgcggtggcggccgctctagtactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtggtcgccatcctggccggggtggtgggcgcggcgtccaagctgggcggcgtgcaccacgtgcgcgcctgggggcaccacaggctgggcaccaacgccgcgtcgtcgctcatcggctggggcatcacggcgctcggcttcg

SEQ ID NO: 37335 - protein, 101 aa, Zea mays
  misc_feature: Ceres CLONE 1422954-F
  misc_feature (14)..(101): Pfam Name: AWPM-19 Pfam Description: AWPM-19-like family
MAGIGRNMVAPLLVLNLIMYIIVIGFASWNLNHFINGQTNYPGVAGNGATFYFLVVAILAGVVGAASKLGGVHHVRAWGHHRLGTNAASSLIGWGITALGF

SEQ ID NO: 37336 - DNA, 642 bp, Zea mays
  misc_feature: Ceres CLONE 1422955-F
  misc_feature: Encodes the peptide sequence at SEQ ID NO. 37337
aaagctggagctccccgcggtggcggccgctctagaactagtggatcccccgggctgcaggaattcgcacgagaccattacctagaacatcctaatcgaaaaaatcagaaatcgacgagtgatgtacgtaactgatccagccaccccggtcgagtgccacccactccacggcgccgaatcgcagataatgtagagtgcgccgcgccgtgacggcgtggatgagaaagcctccaaacctctctgtttcgggctctccgtccccggcgtccaacacccatactctccccaggttgtgtgccacacccacactcaactatatacgaaaaccgccggcgcctggcccctaggccctagtcacagacccttgttctttcttcgacgcgcccccgggcatggcgaaccgcagtgttgccatgggcttggccctcgcgttcgtggccatgaccgcgctctgttgcgcgccgggcgccgcggagttgccccggctggacccaccggccaggagcgacggatcgctgaagctgctcgtcgtcggggactggggacgcaaggggactcacaaccagtcccgggtcgccgaccagatgggaagggtccgggagaaactccatatccacttttgtattttccccggggacactt

SEQ ID NO: 37337 - protein, 83 aa, Zea mays
  misc_feature: Ceres CLONE 1422955-F
MANRSVAMGLALAFVAMTALCCAPGAAELPRLDPPARSDGSLKLLVVGDWGRKGTHNQSRVADQMGRVREKLHIHFCIFPGDT

SEQ ID NO: 37338 - DNA, 740 bp, Zea mays
  misc_feature: Ceres CLONE 1422964-F
  misc_feature: Encodes the peptide sequence at SEQ ID NO. 37339
ggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgaccgccgcgccgcattcgacgcgaggcgctctcgggttttttgcgacggcggagccgaaacaggccgcgaccatggtggcgccatcttccccgcagggcgttccccgggttcgcggtcctgcccccaggcccagggggtcgaagacatagcgccccccccgtccccgaaaggccctcccggggttttgcttgacccccgggctccccgccaacaccaggtgcctccggtgaagggcccccgcccccggggggaaaccttgaaggctcccccaccagcagcattttggcgccc

SEQ ID NO: 37339 - protein, 76 aa, Zea mays
  misc_feature: Ceres CLONE 1422964-F
MTYVNPDPQPLAAATADDSATQHQAAVTAAPHSTRGALGFFATAEPKQAATMVAPSSPQGVPRVRGPAPRPRGSKT

SEQ ID NO: 37340 - DNA, 741 bp, Zea mays
  misc_feature: Ceres CLONE 1422967-F
  misc_feature: Translation starting site: 181
aagctggagctccccgcggtggcggccgctctagaactagtggatcccccgggctgcaggaattcgcacgagaccattacctagaacatcctaatcgaaaaaccggtccaccgcgcatcgaacccccacttgtgccgattctgctgatccctcgccgacaacggccggcgaatcgacaccatggccgctgcgcgccggggccgtggcgacggcgccaacggcgtcgtccgtccccgcccccgcgaccgcggcgggagcatggcggggcgcgtggccgtcctcgccttctgtgtcgcagggatctggtccgcctacatctaccagggcgtcctccaggagactctatcgacgaagcggttcgggccggatgcgcggcggttcgagcacctcgcgttcctcaacttcgcgcagaacgtcatctgcttcgtctggtccttcataatgattaagctgtggtcgggcgggagtagctccaatggcagcgcaccgatatggaagtactgggggcgtcagcgtcaccaataccatcgggccgaccatggggatcgaggctctcaagtacatcagctacccggctcaggtgttagcaaaatctttctaagatgattcctgttatgttgatgggaactcttctctatggtgtgaaagacacacttccagagtatttatgcacctttcttggtgccggcgggggtgtcctccttttgcgttgttgaaaacaaacttccagacaatttaaaa

SEQ ID NO: 37341 - DNA, 636 bp, Zea mays
  misc_feature: Ceres CLONE 1422968-F
  misc_feature: Encodes the peptide sequence at SEQ ID NO. 37342
aagctggagctccccgcggtggcggccgctctagaactagtggatcccccgggctgcaggaattcgcacgagaccattacctagaacatcctaatcgaaaagtccttgtgcgttccttgtagccatctccgactccgcgcctccgctgcctcccgaaagcattgccagttcctccgcacaacatgacgcgcatccaccgcctccgccccctcttcctcttcgttctcttggcgtcgctgcaatgcggtgcggcgacggcggcggctggatacggaggtggcgccgaggggttctgctcggcggagccgtccagcaagtgctccggggatcagccgctctactggaaggtcacccatcccaccctcgcgcccgcgcacctccaagatttacctggcttcacacgtagtgttttcaaaagggatcatgctttaataacaccagagagtcatgtattcagtcctttgcctgattggatcaatacagtaggagcatatttgatcagtccagctattggtgcacacttcattatgtatctagcaaacatgcaagatggttcaaaatcagccctaccaccgaaagatgttgaaaggtttgtttttgtactacaagggagcatttcattgactgtggggactg

SEQ ID NO: 37342 - protein, 151 aa, Zea mays
  misc_feature: Ceres CLONE 1422968-F
MTRIHRLRPLFLFVLLASLQCGAATAAAGYGGGAEGFCSAEPSSKCSGDQPLYWKVTHPTLAPAHLQDLPGFTRSVFKRDHALITPESHVFSPLPDWINTVGAYLISPAIGAHFIMYLANMQDGSKSALPPKDVERFVFVLQGSISLTVGT

SEQ ID NO: 37343 - DNA, 715 bp, Zea mays
  misc_feature: Ceres CLONE 1422970-F
  misc_feature: Translation starting site: 169
  misc_feature (451)..(451): n is a, c, t, g, unknown, or other
  misc_feature (468)..(468): n is a, c, t, g, unknown, or other
  misc_feature (547)..(547): n is a, c, t, g, unknown, or other
  misc_feature (579)..(579): n is a, c, t, g, unknown, or other
aagctggagctccccgcggtggcggccgctctagaactagtggatcccccgggctgcaggaattcgcacgagaccattacctagaacatcctaatcgaaaaaaattgaccgccattgtgcaaaccagaaccccttcgccattttcaccaactccctccgatcccggccatggcgggggaggactgccgctccggcgcggaaatggacgcgctcgtacgacgcttgaagctccaccggccgtccccatccccctacgaccccgatccggccgcggcccccgtccccgccaccgccggcgacggcgagctgttccggccgcggagagctgccgtgcttgtctgcctcttccgggagacggcagcgagctccgcgtcatcgtcactaagcgctcgtcctcccctctcacccactccggtgaagtttcattgcccagaagaaaaggtcgagaggntgatgctgatgatgtancaccagcgttaagagagtcaaaagaggagattggacttgatccagctctggtaaactgtggtgcctctcttgacacttnctgtccaagcatctctggggaggtgtcctgtngtggcatactgttagacgaacaacctttaaccctgctcttaatatgctgaagtagccgaatatttgatgtcccccgggaaatgtcctcaagaatgaaacaggactccgaggaccgaaaaagatggcccgactttcc

SEQ ID NO: 37344 - DNA, 646 bp, Zea mays
  misc_feature: Ceres CLONE 1422975-F
tggagctccccgcggtggcggccgctctagaactagtggatcccccgggctgcaggaattcgcacgagaccattacctagaacatcctaatcgaaaattccccatctccggataaaaggaaaagagtgtgtctcctttgccatactcctctatggcagctaagtccctgccacctctgtttatcttagtttatgtgggcggaggtcctctcttttttcttgtttctttcgatctgcgaaccgtccaagtccagaacgcgctcttacactcaaggaactcttatagacggcccctctggcttcaacgaagtcatgatcacatgtgcatcctcgtgtctgcacgtagatacgtccatccgaggaggaagacgtacccatacgtatgtttactcaacaattactctgacgggcgccgctgctataagaaccagagagtgcaccgtagtctcagctgccagtactacatcgtggccagcatcatctggtatctactgctcgcataagagcatcggctgtcgtcaactgatgatcactagatgagtctacctctgtgtatcactctgaaatagtcttgcaacccgtacatggggatcctgattatatggatgctaccttcagccaagtctggagcaactgattcgagcaca

SEQ ID NO: 37345 - DNA, 715 bp, Zea mays
  misc_feature: Ceres CLONE 1422976-F
aagctggagctccccgcggtggcggccgctctagaactagtggatcccccgggctgcaggaattcgcacgagaccattacctagaacatcctaatcgaaaactagttcccatccattggtgtggacgtgtcacgtgtggtggttgcgttgcggggccccgatttcgagcgggtgttcaattttggtgccggatttttaaggaggatccaatttaggaagaattttggttttggggacaatggtttttgactgcctgatattcgattcataggtttgtcaaacgctttggagtagagaaattttttcccggaaaagaaggagccttttttctagtttgtgctacctcgccaaattcaattccccggtgggaaaggttaaaatctcttcgaaaaaaaaaaaaaacttttgttccaaattataaacccccccggtttttttttccgggtggggggccccccctcttggcccccccccaaaaagacccaattttttttttttgttttcccccgcgcgttttttttttttttataaaaaaaagaagaaaaataaaaaatttttttgggggggggggcccccccccccccccccacaaaaaaatatattttccctcccccgggggggtgtttttcttcttttcttttttagaaaatgcgaagaggtggggcgggtttttttttttttttttttctttttcacagacaccagaaaaactcct

SEQ ID NO: 37346 - DNA, 740 bp, Zea mays
  misc_feature: Ceres CLONE 1422985-F
  misc_feature: Encodes the peptide sequence at SEQ ID NO. 37347
aagctggagctccccgcggtggcggccgctctagaactagtggatcccccgggctgcaggaattcgcacgagaccattacctagaacatcctaatcgaaaaacacccatgtccacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctctcgcgaagtacgctgcggagctgtcggagaagttcgcggccgagaggggtgccttcaccgccgtgctctctggcggatccctcatcgaggcactcaggaagctgacggagccgccgtacctggattcagtggactggagcaagtggcacgtcttctgggtggatgatagggtcgtgcccaaggaccatgtgaatagcaactacaagctcgcctatgatgggtttctcctcaaaggggccgattccctcctggaaaagtttatgccataaatgaatgcctttgccagcctgaaggagcggcaaaacgaactacaaaagcgttgcctgaagccagcttggccaaaaaacggtgttgattttctaatgtccacg

SEQ ID NO: 37347 - protein, 176 aa, Zea mays
  misc_feature: Ceres CLONE 1422985-F
  misc_feature: SWISSPROT Homolog: EC 3.1.1.31 6-phosphogluconolactonase
MSTSVSAAAVAALVPPLTGRRSPPASRVPQICRRRIRSKPRIFSSSPSFPIVPAAAMATGGAAPTASDAGSKKKLLIFDSEEDLAVSLAKYAAELSEKFAAERGAFTAVLSGGSLIEALRKLTEPPYLDSVDWSKWHVFWVDDRVVPKDHVNSNYKLAYDGFLLKGADSLLEKFMP

SEQ ID NO: 37348 - DNA, 728 bp, Zea mays
  misc_feature: Ceres CLONE 1422990-F
  misc_feature: Encodes the peptide sequence at SEQ ID NO. 37349
ggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgacgacgaggtgtcgcgcatgatggaggaggcggacgcggacggcgacggctgcatcagcctgcccgagttcgccgcgctcatggagtccgcgtccgccgacgccgccgccgtcgaggaggacctgcgccacgccttcatggtcttcgacgccgacggcaacggcctcatcacgcccgccgagctcgcgcgcgtcctgcgcggcctcggggagtccgcacccgtcgcc

SEQ ID NO: 37349 - protein, 165 aa, Zea mays
  misc_feature: Ceres CLONE 1422990-F
  misc_feature (92)..(120): Pfam Name: efhand Pfam Description: EF hand
  misc_feature (56)..(84): Pfam Name: efhand Pfam Description: EF hand
  misc_feature (130)..(158): Pfam Name: efhand Pfam Description: EF hand
  misc_feature: SWISSPROT Homolog: EC 2.7.11.1 Non-specific serine/threonine protein kinase
MGKVRSFFSRSRSGKRGSARRAGSSSPHSSAASAPPSPSPLPRRSPSSSSTTTRDETERVFRKFDANGDGQISRSELAALFEGVGHAVTDDEVSRMMEEADADGDGCISLPEFAALMESASADAAAVEEDLRHAFMVFDADGNGLITPAELARVLRGLGESAPVA

SEQ ID NO: 37350 - DNA, 629 bp, Zea mays
  misc_feature: Ceres CLONE 1422991-F
  misc_feature: Encodes the peptide sequence at SEQ ID NO. 37351
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaagagcaacgcccaggcacacacgacacgaaccaggcagccagccgcggagggaggaaccctagcggaacaggtgacggcggcgcgcaaccggtgacgggggatacggcggcatcgtcccctcctccatccccggcgcggcggcgccagcagccggcctgcaggctgtttgaagagcccgccatttaatctcaatggaagccaagtttttccgtttcctgaagctcgttggggtcggcttcaaagcgaggtcagagagccaaggccgtgagttgttccttaaactgggcttcagccatgaggtgcagttcaccgctcctccagctgttcgtgtcttctgcttcaaacccaacataatctgctgcaccggcatcgataaggacagggtgcaccagttcgccggcgccatccggagctctaaggctccagaggtgtacaaggggagctgcatttcctggacgagacgatcacgctgacgccagaggagctttcgagggcgccggctgaagtcctaggcaggagcagccan

SEQ ID NO: 37351 - protein, 93 aa, Zea mays
  misc_feature: Ceres CLONE 1422991-F
  misc_feature (12)..(89): Pfam Name: Ribosomal_L6 Pfam Description: Ribosomal protein L6
MEAKFFRFLKLVGVGFKARSESQGRELFLKLGFSHEVQFTAPPAVRVFCFKPNIICCTGIDKDRVHQFAGAIRSSKAPEVYKGSCISWTRRSR

SEQ ID NO: 37352 - DNA, 649 bp, Zea mays
  misc_feature: Ceres CLONE 1422996-F
  misc_feature: Translation starting site: 556
  misc_feature: SWISSPROT Homolog: EC 1.1.1.1 Alcohol dehydrogenase
agagctggagctccccgcggtggcggccgctctagaactagtggatcccccgggctgcaggaattcgcacgagaccattacctagaacatcctaatcgaaaaacaggctcatctcgctttggatacgattggtatcttaactggggtatggtactgagggtctctccagtggattgatttgccgattctggttcaaggatttgtggaggggggcaatcgccgaccttggagtaatgtgatcaagttgcacaagcctgccgtggcatgggaggccagctagccactgtcgatcgaggaggtggaggtagcgcctccgcaggccatgtgaggtgcgcgtcaagatcctcttcacctcgctctgccacaccgacgtctacttctgggaggccaaggggcagactcccgtgttctctctgatctttggccactaggctggatgtatcatatacagtgttgaacacggtgtgactgacgtagctccgggcgaccatgtcctacctgtgtatcactggggagtgcaacgagtgtgaccactgcatgtccgcatagagcaacatgtgtgatctgctcaagatcaacaccgaccgcggagtgatgattgccgatggtaagtcccggatcttcatcaatcggcagcctatctacgact

SEQ ID NO: 37353 - DNA, 720 bp, Zea mays
  misc_feature: Ceres CLONE 1423002-F
  misc_feature: Encodes the peptide sequence at SEQ ID NO. 37354
  misc_feature (574)..(574): n is a, c, t, g, unknown, or other
  misc_feature (575)..(575): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacccagaacatcctaatcgaaaacactgaaacgaaattaccctatagggatgagatttaaaatgaggtttgaaggtgaagaggctccagaacaaaggttcactgggaccattgttggaaatgtggatcctgatcaagctggatgggctgaatctaaatggcgttacctcaaggtgaggtgggatgaagcttcctccattccacgtcctgaaagggtttctccctggcaaatagaacctgcagtcagccctccccctatcaacccgcttccagtgcacagacccaagagaccgcgctctaatgctgtagcttctctgcccgagtcttcagctccaacaaaagaagctgctccaaaggtcacattagagactcaacaacatgccctgcaaaggcccttgcagacccaggataatgtggccccgagaagtgtttttggtgataacagtgaattggactctgctcataagtcctccctgcgaccgtcaggttttgatcnntgacagagcaccattggcatgcaaaggaagctggggtcagatatttgatgcgaatgaacangcctgatggttacagtgaaaatgtatcgggatattcaccaccctatgagatgtacggaattcgcagggtttctgttctttactt

SEQ ID NO: 37354 - protein, 148 aa, Zea mays
  misc_feature: Ceres CLONE 1423002-F
  misc_feature (1)..(41): Pfam Name: Auxin_resp Pfam Description: Auxin response factor
MRFKMRFEGEEAPEQRFTGTIVGNVDPDQAGWAESKWRYLKVRWDEASSIPRPERVSPWQIEPAVSPPPINPLPVHRPKRPRSNAVASLPESSAPTKEAAPKVTLETQQHALQRPLQTQDNVAPRSVFGDNSELDSAHKSSLRPSGFD

SEQ ID NO: 37355 - DNA, 609 bp, Zea mays
  misc_feature: Ceres CLONE 1423007-F
  misc_feature: Translation starting site: 237
aaagctggagctccccgcggtggcggccgctctagaactagtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagaggacaaggtggtgtacggcaccgcggacctcgggcggccgtgcgcgccgttcgccaagaacgcgtcggagatgcacggcttcacgcagggctgcctgaccctgcgcaggtgg

SEQ ID NO: 37356 - DNA, 625 bp, Zea mays
  misc_feature: Ceres CLONE 1423012-F
  misc_feature: Encodes the peptide sequence at SEQ ID NO. 37357
aaagctggagctccccgcggtggcggccgctctagaactagtggatcccccgggctgcaggaattcgcacgagaccattacctagaacatcctaatcgaaaagtcaacgttctcccgtccccccgagcgcagtctcgcgtggttctcccgtccccccccccgtgccgtggttctccaatcctccctcatccgctctctttctttctctctcgtggcgagtggtaacgacgtcaggtgctcaggtcttgttcaggcccttcgccggcgacgagcacacagcaaatggatacaggagttcaagttatgttcatcatcagtcttgtgctctggtgtactacaagctttgccttggatgatgctgctgctacaaggattccaaatgtgggcacattacctctgtcaatgaaagaaaatccgcaattatgccaactttgtgaggagtttgcatcagaggccctcttctatttaaatgaaaatgagacccagactgaaatcattgatacactacaccaagcttgttcaaagtttggctcttttaagctggagtgcacgaggttggtggattattatgtccctcttttcttcacaaaaattgcttcattaagccctgaagaattttgtgcat

SEQ ID NO: 37357 - protein, 114 aa, Zea mays
  misc_feature: Ceres CLONE 1423012-F
  misc_feature (45)..(83): Pfam Name: SapB_1 Pfam Description: Saposin-like type B, region 1
MDTGVQVMFIISLVLWCTTSFALDDAAATRIPNVGTLPLSMKENPQLCQLCEEFASEALFYLNENETQTEIIDTLHQACSKFGSFKLECTRLVDYYVPLFFTKIASLSPEEFCA

SEQ ID NO: 37358 - DNA, 623 bp, Zea mays
  misc_feature: Ceres CLONE 1423015-F
  misc_feature: Encodes the peptide sequence at SEQ ID NO. 37359
aagctggagctccccgcggtggcggccgctctagaactagtggatcccccgggctgcaggaattcgcacgagaccattacctagaacatcctaatcgaaaaataaatccaattgttccttaaaattacgactcgcacccacggacccaccaaccacgccgccgccggccggccacctttctccattctccgtcaatcgtcatcctatccgatccccaactaggcaactactccgtctcacgcctctcctgtcccctctcgccgctctcgccccgcctctgcctccgcctccgcctcctccatcgcacccagctttcctccccaccccaccgccactcctaccccgccacgtcgtgtagtcgcggcggcggatatgcaagccgccgccgccttcaaccaggcagccttcaccgtccgctcgctgcatcgccccccgaggcccctccatctagctgttgcggaggatgcttttgcggggataagaggcgcgccccttacacggccccggtgctgcgggagcctctctgtcggcgtcggcagctacgacagcgagcacactccagtatttccaagacaacaatcatgggatccctacaagcttcttggtgttgatcaagatgcatc

SEQ ID NO: 37359 - protein, 83 aa, Zea mays
  misc_feature: Ceres CLONE 1423015-F
MQAAAAFNQAAFTVRSLHRPPRPLHLAVAEDAFAGIRGAPLTRPRCCGSLSVGVGSYDSEHTPVFPRQQSWDPYKLLGVDQDA

SEQ ID NO: 37360 - DNA, 729 bp, Zea mays
  misc_feature: Ceres CLONE 1423018-F
  misc_feature: Translation starting site: 383
aagctggagctccccgcggtggcggccgctctagaactagtggatcccccgggctgcaggaattcgcacgagaccattacctagaacatcctaatcgaaaagttcactagcttcggagtttctttcgagataattaaaacgaaaacaatggcgacggttcagttcttcaaccaattcccctgcacaacccgagtccaaagcccaccaaaccctaaacccctctccaagccaacgactctggtgcctatgagcacgatgcactcgccgtccgttgttctcccccggcgaattctccgtttcccgtgcggatttcacagtcagagtcatcgatgcagaacacgagttggatcccgatacgagtgagggaggatctgctctattgatggcagacgaagcaatcaaatccgtgaaacagacggatgttctcaagagatcgctggtggattccttgtaccgcacacaccgatggttgagcgcatccagcgagacgagagccgagatcggagatctaatcacacagctcgagtccaagaaccctacaccagctcccaccgatgctctcttccttctcaacggcaaatggatcctcgcgtacacatcgttgagatggtttgttcccgttgctttcacgagggatcgtgccgttagttaaagtcgacgagatctcacagactattgattcggagaacttcacggtcgagaactctgttctgatcgctggtccgctac

SEQ ID NO: 37361 - DNA, 665 bp, Zea mays
  misc_feature: Ceres CLONE 1423022-F
  misc_feature: Encodes the peptide sequence at SEQ ID NO. 37362
aaagctggagctccccgcggtggcggccgctctagaactagtggatcccccgggctgcaggaattcgcacgagaccattacctagaacatcctaatcgaaaagcactcgcactcgcactcgcacctgcacctcgcactagctagtcttgccaattaagctaggtatagaccagcatggcttctgctctcaagatgacggccatctgcatgctgatcctgaccacgggccagctgatggcaactgccggtgcaaaggcgccgctggtgcaggcggacgccgcgcctacggctcgccgtctgctctcggcggaccatgagcgctcagcctccgggaggacgagcaactgcccctgcaccgccatgactccgtggtgttgcttcggtttgcagaggacggcgacggagaactgcccctgcaccgccaggactccgtggtgttgctccggtttgcagaagacggcgctagaggactgcccctgcagcccatttacaccatggtgctgctccggtttgcagaagacggcgctggagaactgcccctgcacccccatgactccattctgttgctttggcgccggcagtgctgccacaaactgaaatcttcatgagaagaacatgcatgcagatggatgtggcctctaaatgtgtgcggtatggtgcttgcg

SEQ ID NO: 37362 - protein, 140 aa, Zea mays
  misc_feature: Ceres CLONE 1423022-F
MASALKMTAICMLILTTGQLMATAGAKAPLVQADAAPTARRLLSADHERSASGRTSNCPCTAMTPWCCFGLQRTATENCPCTARTPWCCSGLQKTALEDCPCSPFTPWCCSGLQKTALENCPCTPMTPFCCFGAGSAATN

SEQ ID NO: 37363 - DNA, 722 bp, Zea mays
  misc_feature: Ceres CLONE 1423029-F
  misc_feature: Encodes the peptide sequence at SEQ ID NO. 37364
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (22)..(22): n is a, c, t, g, unknown, or other
  misc_feature (33)..(33): n is a, c, t, g, unknown, or other
tcgccgcccccnnnncncgccnaccccgccccnacccgtatatcactcatcctctccccaaagttgttgcgccccggggggggggccgggtcttttctacaaaatcgcccgggctgcaggaattcccccgagaccattacctagaacatcctaatcgaaaacttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgataaacatcctcttccaaatcgtagtctagcccgtgcccaaaaccctagcgaccgccggagagctcgtccgaatcgaggccaccgaggggaaattagatcgcggcggacgatggagagccctgcgaaagaggaggccgggggagagctggcaatggagatcgagtcgtcggtcacggcggaggactggcgccgcgcgctttctcgcgtcgtgccatccgtcgtcgtcctccgcaccactgcgccgcgcgcctttgacaccgcgggtcgcgggcgccagctacgccacgggttttcgtccgttgacaaggccccgcggcataatccctcacttaaccgcccatgtccgtccaagcccaggaccctggtgggtcgccggaagggccatggtttcactgaaaccggggaaa

SEQ ID NO: 37364 - protein, 99 aa, Zea mays
  misc_feature: Ceres CLONE 1423029-F
MESPAKEEAGGELAMEIESSVTAEDWRRALSRVVPSVVVLRTTAPRAFDTAGRGRQLRHGFSSVDKAPRHNPSLNRPCPSKPRTLVGRRKGHGFTETGE

SEQ ID NO: 37365 - DNA, 744 bp, Zea mays
  misc_feature: Ceres CLONE 1423033-F
  misc_feature: Encodes the peptide sequence at SEQ ID NO. 37366
  misc_feature (425)..(425): n is a, c, t, g, unknown, or other
  misc_feature (540)..(540): n is a, c, t, g, unknown, or other
  misc_feature (554)..(554): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (594)..(594): n is a, c, t, g, unknown, or other
aagctggagctccccgcggtggcggccgctctagaactagtggatcccccgggctgcaggaattcgcacgagaccattacctagaacatcctaatcgaaaaattttttcgaccgccgccgcccccagtccccgatccgaagctgtgcctcgtaccatttcgatccaatggcgccgacgtcgaaactgtcgacggggatcaagcgcgcttcgcggtcgcacacgtaccatcgccgtgggctgtgggccatcaaggccaagaacggcggcgccttccccaaggccgacaagggcgccgccgccgtggaacccaaattctaccctgccgacgacgacaaaagcccgcgtttccagcacccgcaagcctaagcctaccaagctcaggtcgagcatcacaccccggggacggtgctgatcctcctcccanaggcgcttcatggggtaagaaaagaaggggtttctcaagcaaatcaaggtctgggctgcctccttactctcctaggggcgcttcagatccatgggagaaccgattccgcccgtgntgagccaacaaacnatgtcattgctacatccacccaagttgacaatccnnnncngtctggtgattgtctcgccccacttactgacaagtactttgccagggagaagaagcagaaggtgaagaagaccgagggcgagctttttgaacagaaaaggaggtaggtgtctgagtaaaaagatccattattttgtcgaccttgcttcat

SEQ ID NO: 37366 - protein, 66 aa, Zea mays
  misc_feature: Ceres CLONE 1423033-F
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKGAAAVEPKFYPADDDKSPRFQHPQA

SEQ ID NO: 37367 - DNA, 838 bp, Zea mays
  misc_feature: Ceres CLONE 1423034-F
  misc_feature (12)..(12): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ggtcgccccctnccccacccccgggggnnnnnnnnnnttgaannnnttatactggagctcaccgcggtggcggccgctctagattcagtggatcccccgggctgcaggaattctcacgagaccattacctagaacatcctaatcgaaaaacatcgagcccgccatcttttcaccctcgttcacggcagaggccgccacccctttagtagggttgtgattggcgcgggagaggacatcggtggggagggtggcggacgacgacacctggggaaggggagggtgggggcataatggcgggcgagtaatcctgctcgggggcgtgctgctgggtggagcatctacggccggggcggaagacggaatggtcgaaggggactataaggaggacgtgcggtggtggcagcgggcgggggagtgggatttataaaaggatacgcggggggggagggaatgcagtaattagtgaaggagggcgccccccccccagctcactcctcgtgagggacggaaacgggggcgtgggaccctgagtctccccgttgcgggagggggaagtggcgggccccagtggccaggggccgccccgaggggcgctgcgggggggggtcccccgaatggatcggaggtggcggctgcgcgtggatgcgctgggacagggcaactcggtgcaaggaggataggggcacgcgcaggcgtagggggtgtggggggtattctcgggagagggggtggagggcggctcgacaacccgagcgaggctactgcgggctgtgaacggcgagcagcgtgcgacgcgatcgccccggcaagcgaaccgcttggtaagcatgagtaaaga

SEQ ID NO: 37368 - DNA, 707 bp, Zea mays
  misc_feature: Ceres CLONE 1423042-F
  misc_feature (209)..(209): n is a, c, t, g, unknown, or other
  misc_feature (283)..(283): n is a, c, t, g, unknown, or other
  misc_feature (476)..(476): n is a, c, t, g, unknown, or other
tccccgcggtggcggccgctctagaactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgcgggncgtcggaaccttccgtgacctggtcccccgccccggcccccctgaggaaaaaccccccccccccccttttcccncaacgccccccctggttggaaccagcggcaacccaacccacccccccccacgttcccaaagtgtattgggtcttggttttggtcctccaacgctttttttttccgggttaccttccctttcccctgtccgccttcctcgattccccgttatcacccctggttacccacttacctcctttttggccccccccgngcacccctccccgtcgacccactcccccgtccacccccgatccccctcccattttttccccccccccgccctctacttgatttcccgtacccggcgcaccccaccccggagtagtcccggaccacttcccttagcccgcccccccaaccgcaaaaacaccaattgtttatgtgcctttgggctccggcgccttctccctacaaggaatgagtacatagcgtattccccccc

SEQ ID NO: 37369 - DNA, 656 bp, Zea mays
  misc_feature: Ceres CLONE 1423047-F
  misc_feature: SWISSPROT Homolog: EC 2.4.2.7 Adenine phosphoribosyltransferase
  misc_feature (224)..(224): n is a, c, t, g, unknown, or other
  misc_feature (292)..(292): n is a, c, t, g, unknown, or other
  misc_feature (656)..(656): n is a, c, t, g, unknown, or other
aaagctggagctccccgcggtggcggccgctctagaatagtggatcccccgggctgcaggaattcgcacgagaccattacctagaacatcctaatcgaaaaattccttcactgccagtcttgcatcccgtccccgtccgcgccgggcgacgccgcctttttcgtcccccgcgtcagcgtcgcggctccacttgagcgtgcgtgtcaccggccggaggcaaaggncaagcccttggtggggcggaaaggggtcccttaaacccccctttgggggggggatgcttcttccattnggggccattcacgatcttcccacaaggcaggggatatgtttccagaaaattcaccacgttgttggcaattccccaaggggttcctgaccacattcgaccttttttgtcagcggtcaggaccaggggaatcaccgtgggtttgcttgggttgaaaactaaaagggtcccttttttggggccttcaattcccttttaccattgggcgccaaattttgtgcctttaagaaacccaaaaaattgcccagggaagtgatctctcccaaaaattttcctttggaaattggaactgacagaatgaaattgcttgtcggactttacaggccaacaacccgggctctttgtagccaatgaccttatttgctan

SEQ ID NO: 37370 - DNA, 639 bp, Zea mays
  misc_feature: Ceres CLONE 1423049-F
  misc_feature: Encodes the peptide sequence at SEQ ID NO. 37371
  misc_feature (597)..(597): n is a, c, t, g, unknown, or other
ggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctggctcccccaccacccgggcggcgacctcccgcttctcaccctggcggggcaggacgccaccgacgccttcgccgcctaccacccgccctcggggcgccccgctcctccgcgcttcttcgttggccgccctctcgactacgccgtctcccccgcggtcgccgactaacgccgcctcctcgcgcagctatcctccgcgggcctcttcgaacgcgtcggccccaccccccaaggtcagctcgtcctgatgggncgtctcttctacgccgcgctctacctcgttctcggctgcgcc

SEQ ID NO: 37371 - protein, 105 aa, Zea mays
  misc_feature: Ceres CLONE 1423049-F
  misc_feature (22)..(95): Pfam Name: Cyt-b5 Pfam Description: Cytochrome b5-like Heme/Steroid binding domain
  misc_feature: SWISSPROT Homolog: EC 1.7.1.3 Nitrate reductase (NADPH)
MPPSVDAMPAPGDAAGGGDVRMISSKELRSHASADDLWISISGDVYDVTPWLPHHPGGDLPLLTLAGQDATDAFAAYHPPSGRPAPPRFFVGRPLDYAVSPAVAD

SEQ ID NO: 37372 - DNA, 692 bp, Zea mays
  misc_feature: Ceres CLONE 1423050-F
  misc_feature: Encodes the peptide sequence at SEQ ID NO. 37373
aagctggagctccccgcggtggcggccgctctagaactagtggatcccccgggctgcaggaattcgcacgagaccattacctagaacatcctaatcgaaaaatccagtcgcacctccctctccgaaatcaaggtagcatacaccgctgcagtttctagagccctctctgccactcgtgatcccactagtcacgatgcctgccctcgctaagcccgcctcccgcaccgccaagcccgccgcggctccgaagccgaagcctgccgccgccaagccgaaggcggccaccgctggtgcctcccacccgccttacttcgagatgatcaaggaggctatcacggcgctaaaggagaagaccggctccagctcgcaagcgatcgccaagtatgtgggggacaagcacggcgcgtctctgccggccaacttcaagaagatgctttccatcccgctccgttgggtccgcagccaaagccaagctcgtgaagggtaagggttccttacaagctcctcggacgcccgccaaaaaaggcatccccccaagaaccaaggcttaaccccgccaaagcccgccccctggccaaagaccccccccccccaaagccccggccaagggcccgccccccccccaagtccaaaaaaaggggaagcgggttgcgccaagccaaaaaaaaagcctcgcttgccttcctgggaaa

SEQ ID NO: 37373 - protein, 97 aa, Zea mays
  misc_feature: Ceres CLONE 1423050-F
  misc_feature (35)..(95): Pfam Name: Linker_histone Pfam Description: linker histone H1 and H5 family
MPALAKPASRTAKPAAAPKPKPAAAKPKAATAGASHPPYFEMIKEAITALKEKTGSSSQAIAKYVGDKHGASLPANFKKMLSIPLRWVRSQSQAREG

SEQ ID NO: 37374 - DNA, 567 bp, Zea mays
  misc_feature: Ceres CLONE 1423052-F
  misc_feature (328)..(328): n is a, c, t, g, unknown, or other
  misc_feature (329)..(329): n is a, c, t, g, unknown, or other
  misc_feature (332)..(332): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (404)..(404): n is a, c, t, g, unknown, or other
  misc_feature (406)..(406): n is a, c, t, g, unknown, or other
  misc_feature (410)..(410): n is a, c, t, g, unknown, or other
  misc_feature (411)..(411): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (441)..(441): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (469)..(469): n is a, c, t, g, unknown, or other
  misc_feature (472)..(472): n is a, c, t, g, unknown, or other
  misc_feature (473)..(473): n is a, c, t, g, unknown, or other
  misc_feature (475)..(475): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (494)..(494): n is a, c, t, g, unknown, or other
  misc_feature (511)..(511): n is a, c, t, g, unknown, or other
  misc_feature (529)..(529): n is a, c, t, g, unknown, or other
  misc_feature (539)..(539): n is a, c, t, g, unknown, or other
  misc_feature (551)..(551): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatgggcggaccgtgaccgcagcggcatctacggcggcgcccacgccacctacgggcagcagcagcagcaggggaggaggcggggcgcccccaatgggggtggagaacacagggggggaaaaggnnggngnnnnnnnnnnnnnnnnnnnnnnnnnnnnnnnnnnnnnnnnnnnnnnnnnnnnnngtnngnggggggggggngngggnncctnnngcgccnngngnnnnnnnnnnnngngccccgcccnnncccccccccccccccnccnncngggcgggggggggnnnngngccccaacaaaccaggnagagagcgagagggaganacagaaaacncccaaaaggggnaggggggggggggggg

SEQ ID NO: 37375 - DNA, 674 bp, Zea mays
  misc_feature: Ceres CLONE 1423054-F
  misc_feature: Translation starting site: 161
  misc_feature: SWISSPROT Homolog: EC 2.3.1.15 Glycerol-3-phosphate O-acyltransferase
  misc_feature (1)..(1): n is a, c, t, g, unknown, or other
nagaactggagctccccgcggtggcggccgctctgtcctagtggatcccccgggctgcaggaattctcacgagaccattacctagaacatcctaacgaaaaacgacggccgcctcgtgcagcgcccgacgccgctcgtcgcgctcgtcaccttcctctggatgccgttcggcttcgcgctggcgctcatgcgcgtgtacatcaacctgccgctgcccgagcgcatcgtctactacacctacaagctcatgggcatcaggctcgtcgtcaagggcaccccgccgccgccgcccaagaagggccacccgggcgtcctcttcgtctgcaaccaccgcaccgtgctcgaccccgtcgaggtggtcgtggccctccaccgcaagggcagctgcgtcacctacagcatctccaagttctccgagctcatctcgcccatcaaggccgtcgcggctgtcgcgggagcgcgacaaggacccctagaacatcccgcgccctgttggaggagggcaacctggtcatctgccccgagggtaccacctgccgcgagcccttcctggtgctcttcagggcgctcttcgccaagttcaccgacccgttcgggcccctggcccaccaccaccaaagaaactattgttccccggctcccccgtgcgcggcttctaagctctggatgcctac

SEQ ID NO: 37376 - DNA, 657 bp, Zea mays
  misc_feature: Ceres CLONE 1423056-F
  misc_feature: Encodes the peptide sequence at SEQ ID NO. 37377
atagctggagctccccgcggtggcggccgctctagaactagtggatcccccgggctgcaggaattcgcacgagaccattacctagaacatcctaatcgaaaactttctcgagcctgacccttacgccttcgctcgcgccgccgccgccgacgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactggctgttttgccgagacaatgctccttatatttggtttatgctctaggatctcaaagttgtgttgttgagatttgccctcggttaccgttctg

SEQ ID NO: 37377 - protein, 92 aa, Zea mays; identical to SEQ ID NO: 7812
  misc_feature: Ceres CLONE 1423056-F
  misc_feature (2)..(91): Pfam Name: Ribosomal_L37ae Pfam Description: Ribosomal L37ae protein family

SEQ ID NO: 37378 - DNA, 633 bp, Zea mays
  misc_feature: Ceres CLONE 1423059-F
  misc_feature: Translation starting site: 294
aagctggagctccccgcggtggcggccgctctagaactagtggatcccccgggctgcaggaattcgcacgagaccattacctagaacatcctaatcgaaaaatcccctgcgcctgccctcccctcctgcagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaagggaccccaacaagcctaagagggctcccagcgctttcttcgtgttcatggagggattttcgcagggagttcaaggagaaaaacccttagaacaagtctgtccctgcggtggggaaaagctgctggcgacagggtggaaatccctgaacgagtcggaccaaggtcccctatggagcaaaggctaaacaagctcaagctccagtaacaaaagggccatcgctggcctaaaaaaa

SEQ ID NO: 37379 - DNA, 663 bp, Zea mays
  misc_feature: Ceres CLONE 1423060-F
  misc_feature: Translation starting site: 245
  misc_feature: SWISSPROT Homolog: EC 5.3.99.6 Allene-oxide cyclase
aaagctggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggccccggcagagccgcagcggcggcgtccccctggcgggcgtcgctgttctcccccaagccccgcggcggccaaagacgcgcggccgaacaaagtgcaaggagctgtacttgtaccaaatccaagagcggggacgccagaaccccgcgtaccttgccctccaacccaaacagaacgagaacgcccctgggcgaatctgtccccctccccaccaaggtgtccaccggcacccttgaaaagccggtgggggtcaccgccgggaattgggtggttattcaagaaggtccccaacagcaaggggaaaccctatagagg

SEQ ID NO: 37380 - DNA, 577 bp, Zea mays
  misc_feature: Ceres CLONE 1423063-F
  misc_feature: Encodes the peptide sequence at SEQ ID NO. 37381
  misc_feature (332)..(332): n is a, c, t, g, unknown, or other
  misc_feature (340)..(340): n is a, c, t, g, unknown, or other
  misc_feature (341)..(341): n is a, c, t, g, unknown, or other
aaagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacngttcgcgnnctgtacgcggcaccaaaccccgaaacggcagtggaaaacaccactacttttcccccctaaccagaatttcttcagggggccctctttggactccgaaaaaagcgcaacgcggtgtttatatgggggggggaaaaacccccggtggggaaaaaaattttccctccctctccccccggaaagaaaaacccttgtttgccccccccccccccccccaaaaaaaaaaaaaggggggggcg

SEQ ID NO: 37381 - protein, 81 aa, Zea mays
  misc_feature: Ceres CLONE 1423063-F
  misc_feature (62)..(62): Xaa is any aa, unknown, or other
MASSDGKPLPTPASVGGGGGSSTAPPGQPTTVASKVLDMGAAAMQSLRPVKQAKQHMCTVRXLYAAPNPETAVENTTTFPP

SEQ ID NO: 37382 - DNA, 719 bp, Zea mays
  misc_feature: Ceres CLONE 1423069-F
  misc_feature: Encodes the peptide sequence at SEQ ID NO. 37383
  misc_feature (23)..(23): n is a, c, t, g, unknown, or other
  misc_feature (24)..(24): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (138)..(138): n is a, c, t, g, unknown, or other
  misc_feature (141)..(141): n is a, c, t, g, unknown, or other
  misc_feature (142)..(142): n is a, c, t, g, unknown, or other
aaaagagacccccccccggcccnncccagccggggccccccccggaaagaatcaccagggggggggggggggggggggnnnntcaaagctggactccccgcggaggcggccgcgccaagtacaacaagagctgacganccnngagcgtttccaaaaacgacgaacatatagatcctcatcgtcgaccccatccgtggtgctcccggtgcgccaggctaccagagtccgacgcagacgtagctcccggccacagcagagcccacgccttgagcccttgacgcgctccgtgtgagtggagcgtacgggcgccggccggcggccagagaggaaacggatctaggaggctcagctgagtcgaggagatggaccgcaaagatgtcgggatcctcgccatggacatctacttcccgccctcctgcgtgcagcaggaggcacttgaggcccatgatggggcgagcaaagggaagtacaccattgggcttgggcaagattgcatggccttttgcagcgaggtggaggatgtcatctcaatgagtttgacggttgtcaattctctgctgaaaaaatacaagattgatcccaagttaatcgggcgcttggaggttggaagtgaaacagttatagacaaaagtaaagccatcaaaacttggctgaagcagatctttgaggaaaggggtaacagggaacatgaaaggcgtggaccccagcaaggcagggtg

SEQ ID NO: 37383 - protein, 119 aa, Zea mays
  misc_feature: Ceres CLONE 1423069-F
  misc_feature (2)..(117): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
MDRKDVGILAMDIYFPPSCVQQEALEAHDGASKGKYTIGLGQDCMAFCSEVEDVISMSLTVVNSLLKKYKIDPKLIGRLEVGSETVIDKSKAIKTWLKQIFEERGNREHERRGPQQGRV

SEQ ID NO: 37384 - DNA, 633 bp, Zea mays
  misc_feature: Ceres CLONE 1423071-F
  misc_feature: Encodes the peptide sequence at SEQ ID NO. 37385
aaagctggagctccccgcggtggcggccgctctagaactagtggatcccccgggctgcaggaattcgcacgagaccattacctagaacatcctaatcgaaaaaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcaaggatatatagataatatacaaacaaaggttcctccagagcccagagcaggagggaagtcaccggccgtcggcggggaggagatgtcggacggcgcgggctcccggacgggcgtcgctggcgcgctgggcctctcggtcacctcgtcggtggccatcgtcatctgcaacaagtacctcatcagcactctaggcttcttcttcgcgacgacgctgacgagctggcacctcatggtgaccttcttcacgctgtacgttgcgcagcggctgcgcttcttcgagccaaagccgatcgacgcgcgcaccgtcatcttcttcggcctggtcaacgggattctccattggcctccccacccctggcctcggggtcaaccccggt

SEQ ID NO: 37385 - protein, 98 aa, Zea mays
  misc_feature: Ceres CLONE 1423071-F
MSDGAGSRTGVAGALGLSVTSSVAIVICNKYLISTLGFFFATTLTSWHLMVTFFTLYVAQRLRFFEPKPIDARTVIFFGLVNGILHWPPHPWPRGQPR

SEQ ID NO: 37386 - DNA, 629 bp, Zea mays
  misc_feature: Ceres CLONE 1423072-F
  misc_feature: Encodes the peptide sequence at SEQ ID NO. 37387
atagctggagctccccgcggtggcggccgctctagaactagtggatcccccgggctgcaggaattcgcacgagaccattacctagaacatcctaatcgaaaagaggcctcccgtcgcggtggtcgctttcggccctggaccccgctgccggaatcgaatctcctcccctcctttctcctccgacctcccccttcaccccctccgcggctccgccccgacccgtgacgcctcgcttcgcacccctctcgcatctccgccgcatctccgccgcgatcctcccgactagccgcgactgcctcccctccagcggccaggcagaggatggagggggcaggcaaggatggcaacccgttgaggaattatcggattggcaagactctcggaattggctcattcgggaaggtgaaaattacggagcatatcagcactggacacaaggtggcaatcaagattctcaaccgccctaaaatccaaaggcttggaaatggaaaaaaaaatttaaaagagggattaaaaaatttggggggttttttttgcccccccccttttattccccccccctttggggggttttaaaaccccccccgggggaaaatttttttttttttttttggggggattttttttaa

SEQ ID NO: 37387 - protein, 84 aa, Zea mays
  misc_feature: Ceres CLONE 1423072-F
  misc_feature: SWISSPROT Homolog: EC 2.7.11.1 Non-specific serine/threonine protein kinase
MEGAGKDGNPLRNYRIGKTLGIGSFGKVKITEHISTGHKVAIKILNRPKIQRLGNGKKNLKEGLKNLGGFFCPPPFIPPPFGGF

SEQ ID NO: 37388 - DNA, 730 bp, Zea mays
  misc_feature: Ceres CLONE 1423073-F
  misc_feature (730)..(730): n is a, c, t, g, unknown, or other
aagctggagctccccgcggtggcggccgctctagaactagtggatcccccgggctgcaggaattcgcacgagaccattacctagaacatcctaatcgaaaaattaaactcggcgaacgggccaagaaaagcaaaccgagggaggagaaaggcaaggaaagtgggaaggtaggagagagagggagacagggaaagctctcttcctcctcctcctcctctcgaattccgtctcttgtccctgtcgtcctcgcccggtttccccggtttttgagaggggaaagaggaggcggaggagagggatggggagggacgagaggttcccggtgtgggaggccgcgctcggcgccagagtctccgccccctttcccggtggactcttcggtggtatacctttccatgccggaatccgaatacacccccccccgggttgccacgtggatctcggaggaaactccaaatcccccctggatcatcttggagaaactttaccggctggactgcccccccgccgggtggttgcgtacgttgtttgcgcctgtggtgcatcctttatggcatatcgttttatggggtccggggggtaattgtcttcgtgccccccgttcttgcctgggtgccgcccttcttcgcccgcccttagggcgaggtctttgcagcgtggatgggattttagccgtcccaattatgtgggcgagtccacacgccgggctcatatttacctggctaacagn

SEQ ID NO: 37389 - DNA, 642 bp, Zea mays
  misc_feature: Ceres CLONE 1423074-F
  misc_feature: Encodes the peptide sequence at SEQ ID NO. 37390
  misc_feature (618)..(618): n is a, c, t, g, unknown, or other
  misc_feature (642)..(642): n is a, c, t, g, unknown, or other
atagctggagctccccgcggtggcggccgctctagaactagtggatcccccgggctgcaggaattcgcacgagaccattacctagagcatcctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggggcgggaccgactatgggacggacgacagcaagatctcccccgacgagatcctcttcgagggctgcgactacaaccactggctcatcaccatggacttcccggaacccaagccgtcgcgcgaagagatgatcgagacatacctccagactctcgccaaggtcgtcgggaagtatgaagaggccaagaaagagatgtatgcttttagtacgacgacttatggtggttttcaggctgtaatgaccgaggaaatgtcagaaaaaattcgccgtttngcctgaagtagttttcattttgcn

SEQ ID NO: 37390 - protein, 159 aa, Zea mays
  misc_feature: Ceres CLONE 1423074-F
  misc_feature (158)..(158): Xaa is any aa, unknown, or other
MALALRLRRVLAAASTAAPLLRPSTSVARPCPLVPLASPVAPLPLPPWRFLPGGGAGFRSTAAAAARGGTDYGTDDSKISPDEILFEGCDYNHWLITMDFPEPKPSREEMIETYLQTLAKVVGKYEEAKKEMYAFSTTTYGGFQAVMTEEMSEKIRRXA

SEQ ID NO: 37391 - DNA, 613 bp, Zea mays
  misc_feature: Ceres CLONE 1423076-F
  misc_feature: Encodes the peptide sequence at SEQ ID NO. 37392
tctgaactagtggatcccccgggctgcaggaattcgcacgagaccattacctagaacatcctaatcgaaaaattcaccttggctgcagcctgcaacacaatcctacgcttccgacttcaacgcgcgcccctcccattttcacctagccctactcctttgtacataaaggaagatgggagcatatgcaacgactggtatgcagatgatagcaacacgcccttccatcccggcctacaggcaaatacttgggtcgacatcagcactatctgcatttggaaggtcaatctgttccagaactggctttgccatctcttctaaagccacatcagcaggaccactggtttcttcgaattgcaagagggttgttgtgagggcaatgtcgcagagaggtgcccaaggacttcccattgatctcacaggtaaaagagcatttatagctggagttgctgatgataatggttatggttgggcaattgctaaggctcttgctgctgctggtgctgagattcttgttggtacaggggtgcctgcgttgaacttttttgaaacagctttgagacctggaaaattttgatgaatcaccggaagctacctggagggatctcttatggag

SEQ ID NO: 37392 - protein, 133 aa, Zea mays
  misc_feature: Ceres CLONE 1423076-F
  misc_feature: SWISSPROT Homolog: EC 1.3.1.9 Enoyl-[acyl-carrier-protein] reductase (NADH)
MGAYATTGMQMIATRPSIPAYRQILGSTSALSAFGRSICSRTGFAISSKATSAGPLVSSNCKRVVVRAMSQRGAQGLPIDLTGKRAFIAGVADDNGYGWAIAKALAAAGAEILVGTGVPALNFFETALRPGKF

SEQ ID NO: 37393 - DNA, 679 bp, Zea mays
  misc_feature: Ceres CLONE 1423080-F
aaactggagctccccgcggtggcggccgctctagaactagtggatcccccgggctgcaggaattcgcacgagaccattacctagaacatcctaatcgaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggtgagcgccgggaacgagccctccgtcctcctactagctgcgatccgtagccttgcgtcgctttcgcgcctagtctagatcgccacgttctagatctgtggtgttttactttcccgggtgcgggtggtcgaatccttccatcccacaggagagctcgtggcttgtcttttgattagctcggcctcccctgtgtccgtgatcttgattacgttcccgatctgtccgctttaatcattcagaaaggtaggaggccttgaggggcttaagttggaaccactaagtgcccgtccccggtttcgtccttcccctgaaccccaaacgcgcccgcttctttattccccggggggcccttctttcaaggttgaaggaatttctcccccccccatgggtgtggaacccc

SEQ ID NO: 37394 - DNA, 621 bp, Zea mays
  misc_feature: Ceres CLONE 1423083-F
  misc_feature (54)..(54): n is a, c, t, g, unknown, or other
  misc_feature (56)..(56): n is a, c, t, g, unknown, or other
ctcaccgcggtggcggccgctctagaactagtggatcccccgggctgcaggggnanattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcgggaccgtgaccgcagcggcatctacgggggcgccccacgccacctaacggcagcaacagcagcagggaaggaagccgggccccccaatgggtaagcaggtgaaggggatgctccccaaaaaggggccaaagggctccccagggccctaaaagtgggaaacaattttccccccttgggggggctttcttttttggtccttttccgggggttgggggcccttaaaacgccccccctcgggggtgtggggttagcctctgggcccccccccccggggtttcctaaatttttaacgccccctgtgggggcgccccgccccccggtttttattttgggaaaaggcgcgttagggggactcccctaacactaaccgcccctcagagaatcaggggggtttttttttcccccaccaaaacccg

SEQ ID NO: 37395 - DNA, 656 bp, Zea mays
  misc_feature: Ceres CLONE 1423087-F
  misc_feature (465)..(465): n is a, c, t, g, unknown, or other
  misc_feature (508)..(508): n is a, c, t, g, unknown, or other
atagctggagctccccgcggtggcggccgctctagaactagtggatcccccgggctgcaggaattcgcacgagaccattacctagaacatcctaatcgaaaaatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctangaaacctttgctgcctactctcagcaacagcagtttcttccantcaacccactggctgcattgaactctgctgcttatttgcacaaccactaccattcagtcagctagctgctgcctacccccagcaatttcttccattcaacccactgggagcattggactctggctgctattttaccacgccacagcta

SEQ ID NO: 37396 - DNA, 660 bp, Zea mays
  misc_feature: Ceres CLONE 1423091-F
  misc_feature: Encodes the peptide sequence at SEQ ID NO. 37397
aagctggagctccccgcggtggcggccgctctataactagtggatcccccgggctgcaggaattcgcacgagaccattacctagaacatcctaatcgaaaactctctgttgcatttcccgtccttatccttccacccggcggcttaaaccctagttctcactcccatcgccgcttcagctccgccgctgcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacacatacaatttgatctgattttcgataaagagtttgagctgtcgcacacatcaaaaactaccagcgttttcttcactggctacaaggttgagcagccatttccaggaagatgaaatggatcttgattctgaagatgaagaccaagaacctgatgttcccgtagtcaaggaaaatggcaaacctgatgagaagaaacccaaaagttcagaaaggcagttgctgcccttcaaaaacaagtcggaattcaagaagaaccaggatgaccacaattcctgagagga

SEQ ID NO: 37397 - protein, 99 aa, Zea mays
  misc_feature: Ceres CLONE 1423091-F
MEFWGLEVKPGSTVKCEPGYGFVLHLSQAALGESKKSDNALMYVKIDDQKLAIGTLSVDKNPHIQFDLIFDKEFELSHTSKTTSVFFTGYKVEQPFPGR

SEQ ID NO: 37398 - DNA, 641 bp, Zea mays
  misc_feature: Ceres CLONE 1423097-F
  misc_feature: Encodes the peptide sequence at SEQ ID NO. 37399
aaagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtgggaaggaggatgcagccaacaacttcgctcgtggtcactacaccatttggcaaggagattgttgacctgtgccttgaccgcatcaggaagcttgcagatattgcactggtctccagggcttcctcgtct

SEQ ID NO: 37399 - protein, 115 aa, Zea mays
  misc_feature: Ceres CLONE 1423097-F
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIWQGDC

SEQ ID NO: 37400 - DNA, 778 bp, Zea mays
  misc_feature: Ceres CLONE 1423100-F
  misc_feature: Encodes the peptide sequence at SEQ ID NO. 37401
  misc_feature (11)..(11): n is a, c, t, g, unknown, or other
  misc_feature (14)..(14): n is a, c, t, g, unknown, or other
  misc_feature (17)..(17): n is a, c, t, g, unknown, or other
gaataggagtngancgnttcgttgtacaaaggcggtttcaaacttaccccgaatatacggagggtccttaccccctctcacagctggactccccgcggtggcggccgctctatactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagcggaagcaccatgaagtcaaggtgaaggactccaaaaccctttctctttggtgagaaggaggttgctgtgtttggctgcaggaacccctgaggagatccccgtgggggttcggttgggggcggaaaatggttgttgagccccccgggggcttttccctgaaccaggaagaaaggctgtagccttactttgaaggggggggggcccaagaaaggttggccaacctctggctccctagcaaggggtgcccccccagggtttgtgcggttgggggtccaaccggagaagggaggtccaaagtctggaaatttaaccctttgccccccccaaggctatagccggcccacaacctaag

SEQ ID NO: 37401 - protein, 72 aa, Zea mays
  misc_feature: Ceres CLONE 1423100-F
  misc_feature (4)..(70): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQRKHHEVKVKDSKTLSLW

SEQ ID NO: 37402 - DNA, 635 bp, Zea mays
  misc_feature: Ceres CLONE 1423105-F
  misc_feature: Translation starting site: 237
  misc_feature (605)..(605): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagaggacaaggtggtgtacggcaccgcggacctcgggcggccgtgcgcgccgttcgccaagaacgcgtcggagatgcacggcttcacgcagggctgcctgaccctgcgcangtgggacgagctncacgccttctttcagaa

SEQ ID NO: 37403 - DNA, 617 bp, Zea mays
  misc_feature: Ceres CLONE 1423106-F
  misc_feature: Encodes the peptide sequence at SEQ ID NO. 37404
ggagctccccgcggtggcggccgctctattctagtggatcccccgggctgcaggaatttgcacgagaccattacctagaacatcctaatcgaaaaacctttctttccctcttccgtcttccccaacccaaccacccgcaccaagccgacccagagagaggagagcctgcttgcctgcctgggctggactcccccttcgcctcctcctcgtccgatcggccccgccccgcctagctgctgctgctgctgctgctgctgctgcgcgcgcgccgcggcgggacccgggaggagcgccggtggtggtggccgggcccgatggagtgggcgtcggcggcgtacacggctgcggcgctggtgtgcgccgcggcggcgagcgtggtcgcgctcgcgcacatctaccgccacctcctccactacgccgagcccatctaccagcggttcatcgtccgcatcatattcatggtcccggtatatgctgtgatgtcattcctttcccttatcctccctgacaacgcgatatattttaattctattcgagagatatatgatgcttgggtcatctacaattttctctcactctgcttggcatgggtgggaggtcctggtgctgtggtggta

SEQ ID NO: 37404 - protein, 101 aa, Zea mays
  misc_feature: Ceres CLONE 1423106-F
  misc_feature (5)..(101): Pfam Name: DUF300 Pfam Description: Domain of unknown function
MEWASAAYTAAALVCAAAASVVALAHIYRHLLHYAEPIYQRFIVRIIFMVPVYAVMSFLSLILPDNAIYFNSIREIYDAWVIYNFLSLCLAWVGGPGAVVV

SEQ ID NO: 37405 - DNA, 663 bp, Zea mays
  misc_feature: Ceres CLONE 1423107-F
  misc_feature: Encodes the peptide sequence at SEQ ID NO. 37406
ctggagctccccgcggtggcggccgctctagaactagtggatcccccgggctgcaggaattcgcacgagaccattacctagaacatcttaatcgaaaagcgaggtcgaaatccccaaggcgaggcgttgaaacccttaaccctcttccacctcgaagcggcgcgaggagggagagtgtgagtggactcaggaggcggcgggcgaaatgaagcttaacgtcaagaccctcaagggcaccaacttcgagatcgaggcgagccccgatgcgtcggttgctgaggtgaagaggatcatcgaaactactcagggtcagagtacctacccagcagaccagcaaatgctcatataccaggggaaaaatctgaaggatgagaccacttttggaaagcaacggaggttgctgaaaacagcttccttgggtataatgctgtccaaggctaaagcatcctcaagggggagctttcaccgttactgcttgaaaaatttctggaaattccggcccaacttgttggcccccggccaattggttggaaaaaaccccttccaaaacctcctttttgcccccgcttaaaaaggcccccccccagagggcaaaaaaacgggggggccccccagttgtttagggggggttttatccgaaagagttctgatgttttccccccc

SEQ ID NO: 37406 - protein, 121 aa, Zea mays
  misc_feature: Ceres CLONE 1423107-F
  misc_feature (6)..(70): Pfam Name: ubiquitin Pfam Description: Ubiquitin family
MKLNVKTLKGTNFEIEASPDASVAEVKRIIETTQGQSTYPADQQMLIYQGKNLKDETTFGKQRRLLKTASLGIMLSKAKASSRGSFHRYCLKNFWKFRPNLLAPGQLVGKNPFQNLLFAPA

SEQ ID NO: 37407 - DNA, 676 bp, Zea mays
  misc_feature: Ceres CLONE 1423110-F
  misc_feature: Translation starting site: 282
  misc_feature (406)..(406): n is a, c, t, g, unknown, or other
  misc_feature (415)..(415): n is a, c, t, g, unknown, or other
  misc_feature (418)..(418): n is a, c, t, g, unknown, or other
  misc_feature (426)..(426): n is a, c, t, g, unknown, or other
aagctggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccatagctgcgtaaaaagttatggntcttaccanaangacaaaangactgggcgtccaaaaatttggatatacagggacaaagttactaatgaaccaaagggtgatgcaacagtcacctatgaggatccacatgctgcttcagctgctgtggaatggttcgataacaaggatttccatgggagcactattcaggttcacatagctgagtcaaaaagcaaagatgcattcgataaccccacaagtttgaacatcattggtggtgttggtgaacaagatgaactggataatggagca

SEQ ID NO: 37408 - DNA, 618 bp, Zea mays
  misc_feature: Ceres CLONE 1423114-F
  misc_feature (267)..(267): n is a, c, t, g, unknown, or other
  misc_feature (291)..(291): n is a, c, t, g, unknown, or other
aaagctggagctccccgcggtggcggccgctctagaactagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcggngatccccaccatccccgccccccngatggaagctgttcgcgcgcgccaaggtggtgcggctcaagagccaccacgaacagttctgtacgcggacaaagaccaagcgcacgtgacccagacgggacgggcctcggaaacccccgtgggcttggaaccggccccacaaacgggggccctccccttgggaacgggaaggcaatacctccccctcccggggaacccttcccccttgggggaaaaacggccccaaaagggaaaaaaaaaggggccccgggggcccccccccccaaaaaaaattttttggaaaagggggaaacccccgggggggaaaagttttttccaaagggcgcc

SEQ ID NO: 37409 - DNA, 630 bp, Zea mays
  misc_feature: Ceres CLONE 1423118-F
  misc_feature: Encodes the peptide sequence at SEQ ID NO. 37410
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaaacctccacccgtccagcaccgccactgttcgcgccgccgtagccccccaaacccccacaccctccggagcgtcgcagcgatcccacccctccttctccccttcacacgtccatggcggagcgcggcggcgagcgtggcggcgagcgcggcgggtttggccgtggcttcgggcgcggcgggcgcggcgaccgtggcgggcgccgaggcggccgtcgcggcccgcgtcaggaggaagagaagtgggtccccgttacgaagctcggccgcctcgtcaaggagaacaggatcaccaagatcgaggagatctacctccactcgctccccgtcaaggagcaccagatcatcgagaccctcgtgccggggctcaaggacgaggtgatgaagatcacgcccgttcagaagcagacccgcgccggacagcgcacccgcttcaaggcctttgtcgtcgtgggcgactgcgacggccacgtcggcctgggagtcaagtgcgccaaggaggtggccaccgccatccgcggcgccatcatn

SEQ ID NO: 37410 - protein, 138 aa, Zea mays
  misc_feature: Ceres CLONE 1423118-F
  misc_feature (84)..(139): Pfam Name: Ribosomal_S5 Pfam Description: Ribosomal protein S5, N-terminal domain
MAERGGERGGERGGFGRGFGRGGRGDRGGRRGGRRGPRQEEEKWVPVTKLGRLVKENRITKIEEIYLHSLPVKEHQIIETLVPGLKDEVMKITPVQKQTRAGQRTRFKAFVVVGDCDGHVGLGVKCAKEVATAIRGAI

SEQ ID NO: 37411 - DNA, 730 bp, Zea mays
  misc_feature: Ceres CLONE 1423119-F
  misc_feature: Encodes the peptide sequence at SEQ ID NO. 37412
aaagctggagctccccgcggtggcggccgctctagaactagtggatcccccgggctgcaggaattcgcacgagaccattacctagaacatcctaatcgaaaaacgccgcatacgcgtgacaactgtggcacggagaccggattcctcacgcctgctggcgtcgatctcctccggaggctgcttctcaccgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcatcgacatgtgtgattatgctgtggggctaagtcgccaactaaatggatccattataccatctgaacgaccaaaccatatgatgatggaggtgtggaatccccttggagttgtgggtgttataacggcatttaatttcccttgtgctgtgcttggttggaatgcttgcattgctttggtctgtggaaattgtgtcgtctggaaaggtgctccaacaactccactgatcactattgcaatgacaaaaatagtggctagtgtattggagaagaacaacttgccaggcgcaatttttacatctttttgtgggggcactgaaattggtcaagcaattgcccttgacattaggatacctttggtttcattcactggaagtacaagggctggtctaatggttcagcaa

SEQ ID NO: 37412 - protein, 149 aa, Zea mays
  misc_feature: Ceres CLONE 1423119-F
  misc_feature: SWISSPROT Homolog: EC 1.2.1.3 Aldehyde dehydrogenase (NAD(+))
MGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLEKNNLPGAIFTSFCGGTEIGQAIALDIRIPLVSFTGSTRAGLMVQQ

SEQ ID NO: 37413 - DNA, 670 bp, Zea mays
  misc_feature: Ceres CLONE 1423123-F
  misc_feature (402)..(402): n is a, c, t, g, unknown, or other
  misc_feature (538)..(538): n is a, c, t, g, unknown, or other
  misc_feature (670)..(670): n is a, c, t, g, unknown, or other
ggagctccccgcggtggcggccgctctagaactagtggatcccccgggctgcaggaattcgcacgagaccattacctagaacatcctaatcgaaaaatatgactggggtactatgtgactctgggactgttgaagttgcttctcctcttacatcatcagttgacgatgctatactagttcgccactatgtgtcccaaatttgttgtctccagaaaacagcaatatcctgggatcagttaaaataggaaagtatacagagtggtttaatgatgtttctggtcatgagatatcgggtacatgtgacgatgcacttaaacttctctgcagtgctttcggatgtcaaatagaagagataacattaccagagcttgaagagatgcgtactgctcatgttgtctcaanttggctcagaatcattctgtgacttgaatcctcattacaaagcaggaagaaaaactgagtttaccttggatactcgaacaagtttggcactttttgggtctttcactgcaactgattatgtggctttctcaagtantaggaggaggataatgcattatcacatggaagcttttcagaaagtcaatgtcatagcaacttctacaactggcattactgctccaaaaatacttccaagtgctctgaagtcaggagagtcagaattatgttn

SEQ ID NO: 37414 - DNA, 637 bp, Zea mays
  misc_feature: Ceres CLONE 1423130-F
  misc_feature: Translation starting site: 494
aagctggagctccccgcggtggcggccgctctagaactagtggatcccccgggctgcaggaattcgcacgagaccattacctagaacatcctaatcgaaaaacctagaacatcctaatcaaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcagcgttggcagcaccccgatcctgggccagtgcgtcgagtttctgaggcatcagtgcagcccgacggcgacgccctactgctcgcctcagtg

SEQ ID NO: 37415 - DNA, 668 bp, Zea mays
  misc_feature: Ceres CLONE 1423143-F
  misc_feature: Encodes the peptide sequence at SEQ ID NO. 37416
tccccgcggtggcggccgctctagaactagtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttaaaacctacttagaaaccttacaaaaaaaaattaaaaaccctctgaggcatctgctttttagaatgtatcttaatt

SEQ ID NO: 37416 - protein, 118 aa, Zea mays; identical to SEQ ID NO: 12523
  misc_feature: Ceres CLONE 1423143-F
  misc_feature (13)..(116): Pfam Name: MAP1_LC3 Pfam Description: Microtubule associated protein 1A/1B, light chain 3

SEQ ID NO: 37417 - DNA, 692 bp, Zea mays
  misc_feature: Ceres CLONE 1423145-F
  misc_feature: Encodes the peptide sequence at SEQ ID NO. 37418
  misc_feature (678)..(678): n is a, c, t, g, unknown, or other
aagctggagctccccgcggtggcggccgctctagaactagtggatcccccgggctgcaggaattcgcacgagaccattacctagaacatcctaatcgaaaaagttctactccccgctccccattcacgcactctcactctacctccctccctccctcgccggcgccgcgcgtgctcccgcgggatgctgcgtgcggcgcggtacctgctggggtcgccgggcgcgagcgggttcgggtccaggtcgacggcggaggaggtgaccccggacctgggcgcgacgacggccatcatcacgggcgccacgtccgggatcggcgccgagacggcgcgcgtgctggcgaagcgcggcgcgcgcgtggtgatcccggcgcggagcgccaaggcggcggaggacgtgcgcgcgcgcatcgtggccgagtgccccgccgccgccgtcctcgtgctcccgctcgacctcagctcgctcgcgtccgtgcgcgccttcgccgacaggttcctagcgctcggcctcccgctccacctcctcatgtacgtacgttcgtcgatcggggcgccgccaccgccgccctcgtccaagtccacagtacatgtatgtatgcgtatgtgtgtgatgcctgtgcgcgcgcgcgtgcagaaacaacgccggcaagttctcgcacgggcagctggcgctctncgaggacggcgtgg

SEQ ID NO: 37418 - protein, 169 aa, Zea mays
  misc_feature: Ceres CLONE 1423145-F
  misc_feature (33)..(158): Pfam Name: adh_short Pfam Description: short chain dehydrogenase
MLRAARYLLGSPGASGFGSRSTAEEVTPDLGATTAIITGATSGIGAETARVLAKRGARVVIPARSAKAAEDVRARIVAECPAAAVLVLPLDLSSLASVRAFADRFLALGLPLHLLMYVRSSIGAPPPPPSSKSTVHVCMRMCVMPVRARVQKQRRQVLARAAGALRGRR

SEQ ID NO: 37419 - DNA, 691 bp, Zea mays
  misc_feature: Ceres CLONE 1423147-F
  misc_feature: Encodes the peptide sequence at SEQ ID NO. 37420
  misc_feature (641)..(641): n is a, c, t, g, unknown, or other
aagctggagctccccgcggtggcggccgctctagaactagtggatcccccgggctgcaggaattcgcacgagaccattacctagaacatcctaatcgaaaaataaacaactcgaccaaacccaagtccagacccgcagctcccgtcagccgccggaggcggagggaaccgagccggcgaccggcagaccgcagagaagaggccagaagccgaccgcaggcagccgccaccgcaccaaaacccgaggtctcgaggcaatcgagcgcgcgcgggtcgggggctgcggccatgtcggtgagttgcgggctcgagtgggtggtgtgccttggctgcacgcggtgggcgtggaagcggctcacctacatcggcgcctacgacagcgagacgtggccgccggcgtccgccgacgagttcgagcccgtcccgcgcctctgccgcgccgtgctcgcgaactacgacgaggagctctccagccccaagttcgcgccgccggagcacggctacttcgacatcgaccccaagggcatcctcaagcgggctacctacaaggaggtcggcaacgcgtgcccgccgtacctcgtctacgtcgacgaggcgcacaaggagatcatcctcgccgtgcgcggcctcaacctcgtgcgncacgccgactacaaggtgctcatggacaacaagctcgggatgcagatgtt

SEQ ID NO: 37420 - protein, 134 aa, Zea mays
  misc_feature: Ceres CLONE 1423147-F
  misc_feature (6)..(74): Pfam Name: Lipase3_N Pfam Description: Lipase 3 N-terminal region
MSVSCGLEWVVCLGCTRWAWKRLTYIGAYDSETWPPASADEFEPVPRLCRAVLANYDEELSSPKFAPPEHGYFDIDPKGILKRATYKEVGNACPPYLVYVDEAHKEIILAVRGLNLVRHADYKVLMDNKLGMQM

SEQ ID NO: 37421 - DNA, 644 bp, Zea mays
  misc_feature: Ceres CLONE 1423158-F
ctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcttccttatgctccttggtctttctgcaagtgttgctaccgcgaccattttcccacaatgctcacaagctcctatagcttcccttcttcccccatacctatcaccagcggtgtcttcagtatatgaaaacccaattgttcaaccctacaggatccaacaggcaatcgcaacaggcatcttaccattatcacccttgttcctccaacaaccgtcagccctattacagcagttacctttggtgcatttggtggcacaaaacatcagggcacaacaaactacaaccaacttgtggctagcaaaactttggttcataatttcccaaaaaaaattagtttttttttccttttaccaaagggggggattaaaactccggggtttttttcacaacaaaaatctccttttcccccctgtggttggtcgttccccccccacaatatttttttcctttttccccccaaaagggggttttatactc

SEQ ID NO: 37422 - DNA, 744 bp, Zea mays
  misc_feature: Ceres CLONE 1423160-F
  misc_feature: Encodes the peptide sequence at SEQ ID NO. 37423
  misc_feature (25)..(25): n is a, c, t, g, unknown, or other
  misc_feature (26)..(26): n is a, c, t, g, unknown, or other
  misc_feature (30)..(30): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (380)..(380): n is a, c, t, g, unknown, or other
  misc_feature (589)..(589): n is a, c, t, g, unknown, or other
  misc_feature (590)..(590): n is a, c, t, g, unknown, or other
  misc_feature (695)..(695): n is a, c, t, g, unknown, or other
ttttttttgtgcccccccccccccnnacananaannnnnatnatggttttnnnnnccaaaggtggaactccccgcggtggcggccgctctagaactagtggatcccccgggctgcaggaattcgcacgagaccattacctagaacatcctaatcgaaaaaaagccgcccccgttgccgtagccctgttggtggggtctgatccgtgttgccattttggcgagggtggcccccgcctcctcttctgcctcttcttcttttcgcgacgatcagagaagaagatgacgatcaccattgaacagccccagctcgatgcggtggcggagaggaaagtccccggcggaggcgaccccgcggagctggtgctcgacgccggctttgntgtgtcggacgccaacgccttcggcaagaccttcaggaactacgacgcggagtcggaggggaagtcgacgggagaggatttctaccgggcgaaccacgtgggggaggagcccgagtccgcggcgcggatgcggggggattacgggcggctaggcaagacgggaaacgggcttcggggatctcaccaagcggctgaacgcattcgccgannaaaggcggtcctgaactggggttggcgcccgaatcgagcacctggctgggagcccctccgaggtcgatggcgcagggggctaccccccgacggaggaacgggtcntccaccctccaccgggaagcagtccgcgtaaccctgcggcaaaggggac

SEQ ID NO: 37423 - protein, 148 aa, Zea mays
  misc_feature: Ceres CLONE 1423160-F
  misc_feature: SWISSPROT Homolog: EC 1.13.99.1 Inositol oxygenase
  misc_feature (34)..(34): Xaa is any aa, unknown, or other
  misc_feature (104)..(104): Xaa is any aa, unknown, or other
  misc_feature (139)..(139): Xaa is any aa, unknown, or other
MTITIEQPQLDAVAERKVPGGGDPAELVLDAGFXVSDANAFGKTFRNYDAESEGKSTGEDFYRANHVGEEPESAARMRGDYGRLGKTGNGLRGSHQAAERIRRXKAVLNWGWRPNRAPGWEPLRGRWRRGLPPDGGTGXPPSTGKQSA

SEQ ID NO: 37424 - DNA, 642 bp, Zea mays
  misc_feature: Ceres CLONE 1423161-F
  misc_feature: Encodes the peptide sequence at SEQ ID NO. 37425
  misc_feature (394)..(394): n is a, c, t, g, unknown, or other
  misc_feature (575)..(575): n is a, c, t, g, unknown, or other
agagctggagctccccgcggtggcggccgctctagaactagtggatcccccgggctgcaggaattcgcacgagaccattacctagaacatcctaatcgaaaaaaccaactcatgctcgacggaccacctcgtcggagcttcgcatttatcgtgccgtccatgtccatgcaacagccgacgaacgccgcaagccaacttcacgccgcgatggaagcgccattgtcgctctcgtcactgcagctcgccttcacggcggtcgcggcgatcgcggcgctggccgtcgcggtggccgtcacgaggtacaaccggagatacatgggcctgaggctgcctccgggcccgcccgggtggcccgtcgtcggcaacctgttccaggtggcgttctccggcaagnctcttcatccactacatccgcgagctccgcaagagtacggcccccatctgacgctgcgcatgggggaagcgcaccctcggggaatcatcagcaagcgcccaaacttccgcccaaaaggggccctgggtgggaaaaaagggggggggaagttctcccgaaaccccggccccccgcggggganaaaaccccccaggggggaaaaaattttttttctctccccaaaaaaaatttcccccgggggagaaccc

SEQ ID NO: 37425 - protein, 145 aa, Zea mays
  misc_feature: Ceres CLONE 1423161-F
  misc_feature (63)..(63): Xaa is any aa, unknown, or other
  misc_feature (123)..(123): Xaa is any aa, unknown, or other
MEAPLSLSSLQLAFTAVAAIAALAVAVAVTRYNRRYMGLRLPPGPPGWPVVGNLFQVAFSGKXLHPLHPRAPQEYGPHLTLRMGEAHPRGIISKRPNFRPKGALGGKKGGGKFSRNPGPPRGXKPPRGEKIFFLSPKKISPGGEP

SEQ ID NO: 37426 - DNA, 780 bp, Zea mays
  misc_feature: Ceres CLONE 1423182-F
  misc_feature: Translation starting site: 196
  misc_feature (5)..(5): n is a, c, t, g, unknown, or other
  misc_feature (6)..(6): n is a, c, t, g, unknown, or other
  misc_feature (29)..(29): n is a, c, t, g, unknown, or other
  misc_feature (31)..(31): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (780)..(780): n is a, c, t, g, unknown, or other
ggggnngggcccaaaaggggcccctcccntncccncnnnnggaagcttttttcaaaactggagctccccgcggtggcggccgctctagaactagtggatcccccgggctgcaggaattcgcacgagaccattacctagaacatcctaatcgaaaaatccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgctcctctacggaggaggccggcgcgtgcgccgtgatggcgctggagcgggtccccgccgacatccccacacaggggcggcgtggccgccatgtcggacccggggcctcatccccgacagcaagctcgccctacaccatcccgggtcagggccaaaagcccccataccggccctttcgaggaaggccccaaaaccttggaaggcacggggcccacggactcgcctgggaccaaaagcgaggggggtggaaccccggccgaaccaacgcgcgccccccatcaaacaaaccccaacttccccccgccccccacttcatcttggcaggttgccccgcgaacctcgggaggaaggccccttccccaaggggtgccgcctatggggcccccttcctctgtatctcgcaccacaaacgagggggaan

SEQ ID NO: 37427 - DNA, 703 bp, Zea mays
  misc_feature: Ceres CLONE 1423183-F
  misc_feature: Encodes the peptide sequence at SEQ ID NO. 37428
gctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagatcaagagctacctcctggtccggttggacagatcccttcgggcgctgcgtccaccgggattcaggcaaagtggtgtaacataagatgcaaggtggaagaggtgggaggcacggtttgttcggatttggggacccttttgttggtttcggcggctttggacagccagagaacataatgtccggtttctttggtggcgccaatccctttgatgaccctttcttcacaaacccctttggtggcatgatgcaacctagtttctcaacccctttcagcggcatgatgcaacctagcttcatgaacccctttggtagcagtgatgcaacctagcttgcttggatcaagtgtgtttgccgcccatgacaatctcaatggaggcacttttggaagccagacacatgtcaatcaaggtgtgagcaatgcccgtggtttcattcaacaagcctctgaatcgagcaggcctaaacggccaattatcacggagttgtcttcagatgacgaggatcaagctgatgatgatcagaaacatgaca

SEQ ID NO: 37428 - protein, 80 aa, Zea mays
  misc_feature: Ceres CLONE 1423183-F
MQGGRGGRHGLFGFGDPFVGFGGFGQPENIMSGFFGGANPFDDPFFTNPFGGMMQPSFSTPFSGMMQPSFMNPFGSSDAT

SEQ ID NO: 37429 - DNA, 704 bp, Zea mays
  misc_feature: Ceres CLONE 1423185-F
aaagctggagctccccgcggtggcggccgctctagaactagtggatcccccgggctgcaggaattcgcacgagaccattacctagaacatcctaatcgaaaaaaatatataagagattagtgtagcacggttctgccagtgccatccgcgccctcagccgaggatctccattctcctccccacgcagaatccaccgcgaggtctccgccgccctaaccgcgcccttccatccatggttgcagtggtgtcgtgctccccagatctaccacgggcgcgtgcccggatctggcccgacgaacagcggtggagctcgcgcggtgttccattcatggattgggatctcaagatgtcggtctcctaggacctccgcgacttcccccgcgacagcgtcgggcattgccgccgcagctgccgcgccttccctcgcgacggcgccgagcccgagcggagtgctccgtcgacctcaaggctcgcaggacgacaccaccacggaaggagccggtggcttgcaaccgcagccgccgtccgccagccccaatggggcggcgtcgggcatttgcccgcccgcagctgccgaagcccttccccccccaaccggtgcttaaaccggggcgggagttgctcccgtccaacctcaaagcctccgggggggcttaggcgcccaagaagacagcccccccggggcccccgggggaaccctgcca

SEQ ID NO: 37430 - DNA, 645 bp, Zea mays
  misc_feature: Ceres CLONE 1423187-F
  misc_feature (137)..(137): n is a, c, t, g, unknown, or other
  misc_feature (174)..(174): n is a, c, t, g, unknown, or other
  misc_feature (316)..(316): n is a, c, t, g, unknown, or other
  misc_feature (361)..(361): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattnggtctgaatactgtagctactagcgcgagtgccactngtgccgcagctgcctgctcgccattactgcaagctgtgttcaatcaaagcttaattaggctccctctacatctgatccagctaagtagctagccagcactacagaagggcgtggcaagaatcaggagagagatagcaggggnggctagctagctgagctcgtgcgacgaagaaatgccggaatttgncagggacctggggggccccgcctcccgggggccaaaccccacatggaactacccccatgggttcccgaggtgaacttaaccctttttaaaggggaaaaaatatccccgggggggcggaaaagggcgcaatttaatttcggggggccccccccccggggggggggggggggcggggcccaaaaggggggggggggaacaaagggggcgcggggggggccaaaaaagggggcccacaaaaaaccggggtgttcttattacttggggggggaaaaaaaggggccctc

SEQ ID NO: 37431 - DNA, 716 bp, Zea mays
  misc_feature: Ceres CLONE 1423189-F
  misc_feature: Encodes the peptide sequence at SEQ ID NO. 37432
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctaccgcgacctccagcgcgggggcggcatgcactgcgaggcgcatcaccagcataagcagggcgccatgatgacggcgctcaaggtcgcgacggccgcgaccttcggcgggtcgatgctggtgctgtccaggctgatcctggccggcaccgtgatcgcgctcacggtggccacccccgtgctggtgatcttcagcccggtgctggtgccggccgccatcgcgctggcgctcatggcagccgggttcgtcacctccggcggcctcggcgtcactgcgctgtccgtgttctcctggatgtacaagtacctgacaggcaagcacccgccgggcgcctaccagctggaccacgccaaggcgaggctggcgtccaaggcccgcgacatcaaggatgcatcacagcaccgcatcgaccaggcgcaggggtcttgagagaagatcacactcgagcggactgcgcgcgcgacctccttgagcact

SEQ ID NO: 37432 - protein, 156 aa, Zea mays
  misc_feature: Ceres CLONE 1423189-F
  misc_feature (36)..(146): Pfam Name: Oleosin Pfam Description: Oleosin
MADHHRGATGGGGGYRDLQRGGGMHCEAHHQHKQGAMMTALKVATAATFGGSMLVLSRLILAGTVIALTVATPVLVIFSPVLVPAAIALALMAAGFVTSGGLGVTALSVFSWMYKYLTGKHPPGAYQLDHAKARLASKARDIKDASQHRIDQAQGS

SEQ ID NO: 37433 - DNA, 715 bp, Zea mays
  misc_feature: Ceres CLONE 1423200-F
  misc_feature (204)..(204): n is a, c, t, g, unknown, or other
  misc_feature (257)..(257): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (468)..(468): n is a, c, t, g, unknown, or other
  misc_feature (470)..(470): n is a, c, t, g, unknown, or other
  misc_feature (498)..(498): n is a, c, t, g, unknown, or other
  misc_feature (521)..(521): n is a, c, t, g, unknown, or other
  misc_feature (522)..(522): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (545)..(545): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (574)..(574): n is a, c, t, g, unknown, or other
  misc_feature (610)..(610): n is a, c, t, g, unknown, or other
  misc_feature (611)..(611): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (633)..(633): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
ctccccgcggtggcggccgctctagaactagtggatcccccgggctgcaggaattcgcacgagaccattacctagaacatcctaatcgaaaaatatctcctcaaggcacgttcaccacagtcctcttctttccccggcaccaccaccacccaggctaaccggactggaccgagtgttgaacaacactgagggcgaagcaaatanagcgacggcaggcatggtgagccgtgaaaattccacctggtgctggacccggntctctgggcccgccctggcccaaccctccgccccaaaaatcccccccaattcctcccccctttgaaaaatacctctcctcccccgccccaaaggggccacaccccgggggagggggagaggggnnnnnnnnnnnngnnnnnnnngggggggggggggggggggnnnnnnnnnnnnnnnnnnnnnnccccccccccccggggcccgggggtntnggtggggagggggcgggggggggggggnaagagagaaccgcacgactcccnntnnnnnnccccccgcgggggccnccccccccccgcgtgggagnnngcgcccncccgccgcgggagtaggggcgggggggcgggggggnnccccnnnnnnnnnnnnnccccnccccccnnnnnnnnnncccccccccccccctttttttcttttctcacacccacaacccccttaacctcccccccctctcctg

SEQ ID NO: 37434 - DNA, 856 bp, Zea mays
  misc_feature: Ceres CLONE 1423203-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (39)..(39): n is a, c, t, g, unknown, or other
  misc_feature (43)..(43): n is a, c, t, g, unknown, or other
  misc_feature (54)..(54): n is a, c, t, g, unknown, or other
nnncccccccccnnnnnnnnnncccccccnncnnncncncccncgggggggtgnatcaaaactggactccccgcggtggcggccgctctagaactagtggatcccccgggctgcaggaattcgcacgagaccattacctagaacatcctaatcgaaaaaatacctcctcaaggcacgttcaccacagtcctctctttccccggcaccaccaccaccacccaggctaacaggactggaccgagtgttgaacaacactgcagtgagcgacggcaggcatggtggagccgtgaaaattttcacctggttgttggacccggctacttctgggctccgcccttgtgcccgaactcttccgcccgctgaacaatcccgtcctcaagattccctccgcccgccagcttggggaaaaaaaaagcttccttcccccctcgcccgccgggcaacgcttctaaaacggaaggtgcgacaccaacgtagctttccctgaaagccaatgatgattttcaagggtgtggtgggttgtttgccccgcccgccgtcgtttcgaacgagacccaccggtaaacggtgaaaacgaggatcgggcctcccctcctagcgcgctgactccctggggtgggaaataactcagacaacactagatcctgactgtcgtcatccccccgccccgcactcgctgggggccaaccacataggaagttggaatcacccttgctctatctgagtaaaatttctcattgactaagaaagaagtcagcgaaggcggacgagagagacaacacaaaagaggggtggatgcgccgcgggagtgtcgtgtctcctccgcgactcaagacgacccccacaattacaacgg

SEQ ID NO: 37435 - DNA, 666 bp, Zea mays
  misc_feature: Ceres CLONE 1423208-F
  misc_feature: Encodes the peptide sequence at SEQ ID NO. 37436
aagctggagctccccgcggtggcggccgctctagaactagtggatcccccgggctgcaggaattcgcacgagaccattacctagaacatcctaatcgaaaaatctatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcaaggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggcctcggcgtcgctgcgctgtccgtgttctcctggatgtacaagtacctgacgggcaagcacccgccgggcgccgaccagctggaccacgccaaggcgaagctggcgtccaaggcccgcgacatcaaggatgcagcacagcaccgcatcgacccagcgcaggggt

SEQ ID NO: 37436 - protein, 155 aa, Zea mays
  misc_feature: Ceres CLONE 1423208-F
  misc_feature (36)..(146): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLGVAALSVFSWMYKYLTGKHPPGADQLDHAKAKLASKARDIKDAAQHRIDPAQG

SEQ ID NO: 37437 - DNA, 620 bp, Zea mays
  misc_feature: Ceres CLONE 1423216-F
  misc_feature: Encodes the peptide sequence at SEQ ID NO. 37438
gctctagaactagtggatcccccgggctgcaggaattcgcacgagaccattacctagaacatcctaatcgaaaaactgttcgcgccgccgtagccccccaaacccccacaccctccggagcgtcgcagcgatcccacccctccttctccccttcacacgtccatggcggagcgcggcggcgagcgtggcggcgagcgcggcgggtttggccgtggcttcgggcgcggcgggcgcggcgaccgtggcgggcgccgaggcggccgtcgcggcccgcgtcaggaggaagagaagtgggtccccgttacgaagctcggccgcctcgtcaaggagaacaggatcaccaagatcgaggagatctacctccactcgctccccgtcaaggagcaccagatcttcgagaccctcgtgccggggctcaaggacgaggtgatgaagatcacgcccgttcagaagcagacccgcgccggacagcgcacccgcttcaaggcctttgtcgtcgtgggcgactgcgacggccacctcggccctggagtcaagtgcgccaaggaggtggccaccggccttccgcggggccatcatcctcgccaagctctccgttgtccccgtcaggagaggctact

SEQ ID NO: 37438 - protein, 152 aa, Zea mays
  misc_feature: Ceres CLONE 1423216-F
  misc_feature (84)..(148): Pfam Name: Ribosomal_S5 Pfam Description: Ribosomal protein S5, N-terminal domain
MAERGGERGGERGGFGRGFGRGGRGDRGGRRGGRRGPRQEEEKWVPVTKLGRLVKENRITKIEEIYLHSLPVKEHQIFETLVPGLKDEVMKITPVQKQTRAGQRTRFKAFVVVGDCDGHLGPGVKCAKEVATGLPRGHHPRQALRCPRQERL

SEQ ID NO: 37439 - DNA, 752 bp, Zea mays
  misc_feature: Ceres CLONE 1423224-F
  misc_feature: Pfam Name: FBPase Pfam Description: Fructose-1-6-bisphosphatase
  misc_feature: SWISSPROT Homolog: EC 3.1.3.11 Fructose-bisphosphatase
aatctggagctccccgtcagtggcggccgctctagaactagtggatcccccgggctgcaggaattcgcacgagaccattacctagaacatcctaatcgaaaaatagtcacagagcctcacgtcacgtgtacctcccccaacccaacccatcccaacccagcccaaaacctagcgggcgaggggccggggaaccgacagtcggaggcggagatggaccacgcggcggaggcacatccgacggacctgatgactatcacgcggcgcgtgctcaacgagtagagccgccacccggagtcccgcggcgacttcaccatcctcctctcccacatcgtcctcgggtgcaagttcgtcgccgccgcggtcaacaaggccggcctcgccaagctcatcggcctcgccggagagaccaacttccacggcgaggagcaaaagaagctggatgtcctgtccaacgaggtcttcgtgaaggcgctcgtcagcagcggccgaacctgtgtcctcgtgtctgaagagaactaggaggccatcttcgtctacccggcccctccgcgggaagtactgcgtctgtttcaacccgctggatggctcctccaacatcgagtggggtatcctcaattcagaaccatctttgggaatttacagtggtccaagacaagggaccaaacttacccttggaaaggatgttgctggcaaacctgtgaaacaaaacatggtcttggctggctaggcctaactgccctccttgtgggcag

SEQ ID NO: 37440 - DNA, 660 bp, Zea mays
  misc_feature: Ceres CLONE 1423228-F
  misc_feature: Encodes the peptide sequence at SEQ ID NO. 37441
  misc_feature (549)..(549): n is a, c, t, g, unknown, or other
aaagctggagctccccgcggtggcggccgctctagaactagtggatcccccgggctgcaggaattcgcacgagaccattacctagaacatcctaatcgaaaaactcctaagcgccgtcgcgatctgctgcggtggccgctgccgtcgccgtccatccccaccgcctcgaccacgccaccgacgccgcctctcgctccccctcgccgcgccgcccgaacgccacgatgcgtcacctcctcctctcccgcttcctccgccgcggtggcggcagcggcatccccaacggccactaccaccacctccccctcctccgcgccctctcctcctccccctccccggtctcctcggacgcagagctccgcaagtacgcgggctacgcgctgcttcttctcggctgcggcgccgcgacccactactccttcccgttccccgccgacgcgctgcacaagaaggccgtgccattccggtacgcgccgctgccggaggacctccacgccgtctcccactggagcggcacgcacgaggtccacgcccgcgtcctgctccagncggactcgctcccggccctccagggcgcgcttcgccccgcgcacaaggagcgccgcaagctcaggcccctcgatccgggctgtccccaatgggatccccctctccccgcct

SEQ ID NO: 37441 - protein, 145 aa, Zea mays
  misc_feature: Ceres CLONE 1423228-F
  misc_feature (109)..(109): Xaa is any aa, unknown, or other
MRHLLLSRFLRRGGGSGIPNGHYHHLPLLRALSSSPSPVSSDAELRKYAGYALLLLGCGAATHYSFPFPADALHKKAVPFRYAPLPEDLHAVSHWSGTHEVHARVLLQXDSLPALQGALRPAHKERRKLRPLDPGCPQWDPPLPA

SEQ ID NO: 37442 - DNA, 672 bp, Zea mays
  misc_feature: Ceres CLONE 1423230-F
  misc_feature: Encodes the peptide sequence at SEQ ID NO. 37443
ctggagctccccgcggtggcggccgctctagaactagtggatcccccgggctgcaggaattcgcacgagaccattacctagaacatcctaatcgaaaaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcggggaactccaaccagttcttcaccgtcgcctttcgaggccggcagcaggctcaagggctccacgctcctttaccgaaggaagtggtgacggaatggatcagaatgaatgggccattcctacggcgggaaccggaaaattttgcttatgggcaaggaggttgtccttccaaaaagaaggtaaccctttgcccaatagggggatgggccccccggggaaacccctggaaacaaacttccagcattggcagggttttttctctgccccgg

SEQ ID NO: 37443 - protein, 175 aa, Zea mays
  misc_feature: Ceres CLONE 1423230-F
MENPAPSIVVPPIAAPVSANFSRLAFRNLYIRRTGPDSREMVTVEGRRGSSDQTGDMRYVSDFPVYDGRGSDAVLVARVQGVTTTFGELQPVLHRRLSRPAAGSRAPRSFTEGSGDGMDQNEWAIPTAGTGKFCLWARRLSFQKEGNPLPNRGMGPPGKPLETNFQHWQGFFSAP

SEQ ID NO: 37444 - DNA, 688 bp, Zea mays
  misc_feature: Ceres CLONE 1423239-F
  misc_feature: Encodes the peptide sequence at SEQ ID NO. 37445
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaagaagtctatctttttctcctcctgccgtacgtccgttccagcttgcaaagcgctcgcgagctgctgccatggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccggcgcctctgggccgccgccgaagccgaggctggctaccgcgtgctcaccccgacgccgcacctctccatgggccggcggagcagcgcctcgctcgccggcggcatcgctaacatcggcgccgaaggagtggacgaagacgacctttcaccgcaggtggggcggcgnccttcccctcaccgtcccgggccccggttgaacgcgtgggtcaccgcgctcagcgaccacgggcggcgtgctcagcgcccaccaaagcccgtggccatgtttcaa
